United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 3

SEQ ID NO: 16952 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tccaaagacagcctggaatt

SEQ ID NO: 16953 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtttgcttccaaagacagcc

SEQ ID NO: 16954 - DNA, 20 bp, Artificial Sequence
  Description of Artificial Sequence: Synthetic oligonucleotide
  Target: ATXN1; (-) strand; PAM type: NNGRRT; PAM sequence: GTGAGT
acagtagatgcagtttgggc

SEQ ID NO: 16955 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cccagcatcctgcattgggt

SEQ ID NO: 16956 - DNA, 20 bp, Artificial Sequence
  Description of Artificial Sequence: Synthetic oligonucleotide
  Target: ATXN1; (-) strand; PAM type: NNGRRT; PAM sequence: TTGGGT
taggagcccagcatcctgca

SEQ ID NO: 16957 - DNA, 20 bp, Artificial Sequence
  Description of Artificial Sequence: Synthetic oligonucleotide
  Target: ATXN1; (-) strand; PAM type: NNGRRT; PAM sequence: CAGAAT
caataatctgtcctcaggac

SEQ ID NO: 16958 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ctgcttggagatggtaaagc

SEQ ID NO: 16959 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tatatgttattaatattata

SEQ ID NO: 16960 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cataggaaatcttaaaggta

SEQ ID NO: 16961 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gaatactccataaatactgg

SEQ ID NO: 16962 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ggtattagactgtcagtatg

SEQ ID NO: 16963 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caccatcctgggctccccag

SEQ ID NO: 16964 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gctttggcctctcagagtgc

SEQ ID NO: 16965 - DNA, 20 bp, Artificial Sequence
  Description of Artificial Sequence: Synthetic oligonucleotide
  Target: ATXN1; (-) strand; PAM type: NNGRRT; PAM sequence: CAGAGT
attctcctgctttggcctct

SEQ ID NO: 16966 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttaattttttttttgtagag

SEQ ID NO: 16967 - DNA, 20 bp, Artificial Sequence
  Description of Artificial Sequence: Synthetic oligonucleotide
  Target: ATXN1; (-) strand; PAM type: NNGRRT; PAM sequence: TGGAAT
accccaacttcccagagctc

SEQ ID NO: 16968 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gtcttgctctgtcacccagg

SEQ ID NO: 16969 - DNA, 20 bp, Artificial Sequence
  Description of Artificial Sequence: Synthetic oligonucleotide
  Target: ATXN1; (-) strand; PAM type: NNGRRT; PAM sequence: CAGAGT
cttttgttttgtttaagaga

SEQ ID NO: 16970 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tatctgctttttcacttccc

SEQ ID NO: 16971 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gggtcatgatcactcttagc

SEQ ID NO: 16972 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ctgaaggttgttgaatagga

SEQ ID NO: 16973 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cggagagccactgaaggttg

SEQ ID NO: 16974 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acattttacagatgagaaaa

SEQ ID NO: 16975 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cggtgagtgtgaactattca

SEQ ID NO: 16976 - DNA, 20 bp, Artificial Sequence
  Description of Artificial Sequence: Synthetic oligonucleotide
  Target: ATXN1; (-) strand; PAM type: NNGRRT; PAM sequence: GTGAGT
taatgataatgatgataacg

SEQ ID NO: 16977 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gctgtggaccagtttgagcc

SEQ ID NO: 16978 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gcccaaaggtgtggagaagg

SEQ ID NO: 16979 - DNA, 20 bp, Artificial Sequence
  Description of Artificial Sequence: Synthetic oligonucleotide
  Target: ATXN1; (-) strand; PAM type: NNGRRT; PAM sequence: TAGGAT
agctgacttggaagaatggc

SEQ ID NO: 16980 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aagcatcagagctgacttgg

SEQ ID NO: 16981 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tgggatatttagtctgattt

SEQ ID NO: 16982 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gctgtgggaacacaaaggag

SEQ ID NO: 16983 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gcaatgctgtgggaacacaa

SEQ ID NO: 16984 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ccttcctacaaacttggttt

SEQ ID NO: 16985 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ttattatcataccactttca

SEQ ID NO: 16986 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aaacaaacaaaaaaacctaa

SEQ ID NO: 16987 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tggtgccactgcattccagc

SEQ ID NO: 16988 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggcgtctgagacag

SEQ ID NO: 16989 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ggtgggtggatcacaaggtc

SEQ ID NO: 16990 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggccatggtgg

SEQ ID NO: 16991 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagcactttgggaggccatg

SEQ ID NO: 16992 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gagcaagtgacttaatctct

SEQ ID NO: 16993 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttgaggcaaacttcctgggt

SEQ ID NO: 16994 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aggttcttgaggcaaacttc

SEQ ID NO: 16995 - DNA, 20 bp, Artificial Sequence
  Description of Artificial Sequence: Synthetic oligonucleotide
  Target: ATXN1; (-) strand; PAM type: NNGRRT; PAM sequence: TTGAGT
attttatttttccagcatta

SEQ ID NO: 16996 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gtctcagcctcccaaagtgc

SEQ ID NO: 16997 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gggggtctcaccgtattggc

SEQ ID NO: 16998 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttttgtatttttagtagaga

SEQ ID NO: 16999 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaagtagc

SEQ ID NO: 17000 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcagcctccgcctc

SEQ ID NO: 17001 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttcgttcttgttgcccaggc

SEQ ID NO: 17002 - DNA, 20 bp, Artificial Sequence
  Description of Artificial Sequence: Synthetic oligonucleotide
  Target: ATXN1; (-) strand; PAM type: NNGRRT; PAM sequence: TGGAGT
attttattttgtttttgaga

SEQ ID NO: 17003 - DNA, 20 bp, Artificial Sequence
  Description of Artificial Sequence: Synthetic oligonucleotide
  Target: ATXN1; (-) strand; PAM type: NNGRRT; PAM sequence: ATGGAT
atacagaccagagtaccttg

SEQ ID NO: 17004 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttaaggatctacatacagac

SEQ ID NO: 17005 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tgaactagtcctgaaatctt

SEQ ID NO: 17006 - DNA, 20 bp, Artificial Sequence
  Description of Artificial Sequence: Synthetic oligonucleotide
  Target: ATXN1; (-) strand; PAM type: NNGRRT; PAM sequence: AAGGAT
caatagtagcttcaatgagg

SEQ ID NO: 17007 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gccctctgcagactgtatgt

SEQ ID NO: 17008 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ctattctgttgcactagcca

SEQ ID NO: 17009 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tgaaatataccatggctaag

SEQ ID NO: 17010 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tgcagagtaaagaaccttag

SEQ ID NO: 17011 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gttgatccttgtctgttttg

SEQ ID NO: 17012 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tgccaaaaggtgaactgtca

SEQ ID NO: 17013 - DNA, 20 bp, Artificial Sequence
  Description of Artificial Sequence: Synthetic oligonucleotide
  Target: ATXN1; (-) strand; PAM type: NNGRRT; PAM sequence: GGGAAT
agagtcaataagttgtaatg

SEQ ID NO: 17014 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gttttttcctattaatgctt

SEQ ID NO: 17015 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gtgtatatacatatataaaa

SEQ ID NO: 17016 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtgtgacaaggaattcagaa

SEQ ID NO: 17017 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgtacgtgtgacaaggaatt

SEQ ID NO: 17018 - DNA, 20 bp, Artificial Sequence
  Description of Artificial Sequence: Synthetic oligonucleotide
  Target: ATXN1; (-) strand; PAM type: NNGRRT; PAM sequence: AGGAAT
catcatttgtacgtgtgaca

SEQ ID NO: 17019 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gttctttccaaaggaaggaa

SEQ ID NO: 17020 - DNA, 20 bp, Artificial Sequence
  Description of Artificial Sequence: Synthetic oligonucleotide
  Target: ATXN1; (-) strand; PAM type: NNGRRT; PAM sequence: AGGAAT
caaaagttctttccaaagga

SEQ ID NO: 17021 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ctattttttttttcatttct

SEQ ID NO: 17022 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ctgaaaggctactctgctct

SEQ ID NO: 17023 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aaaaagactgggtaacatta

SEQ ID NO: 17024 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cttaagggaatttaaaaaga

SEQ ID NO: 17025 - DNA, 20 bp, Artificial Sequence
  Description of Artificial Sequence: Synthetic oligonucleotide
  Target: ATXN1; (-) strand; PAM type: NNGRRT; PAM sequence: GGGAAT
atctggtatttttttcttaa

SEQ ID NO: 17026 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tccagttctggccacatttt

SEQ ID NO: 17027 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tagaaaattctaacatcaga

SEQ ID NO: 17028 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aacagtttttacagtaatag

SEQ ID NO: 17029 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gtaagatattaaaaatgttt

SEQ ID NO: 17030 - DNA, 20 bp, Artificial Sequence
  Description of Artificial Sequence: Synthetic oligonucleotide
  Target: ATXN1; (-) strand; PAM type: NNGRRT; PAM sequence: GAGGAT
attttgagaggctgagggaa

SEQ ID NO: 17031 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gcatggcctctaaggcccct

SEQ ID NO: 17032 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tgctcctgataaggtaaaat

SEQ ID NO: 17033 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gaagtaaaatgaataattga

SEQ ID NO: 17034 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aatgaatatggtgaagtaaa

SEQ ID NO: 17035 - DNA, 20 bp, Artificial Sequence
  Description of Artificial Sequence: Synthetic oligonucleotide
  Target: ATXN1; (-) strand; PAM type: NNGRRT; PAM sequence: ATGAAT
taatactcctttggtagcaa

SEQ ID NO: 17036 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aggctagaagtaaagaaaac

SEQ ID NO: 17037 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cgaaacccagagattggtac

SEQ ID NO: 17038 - DNA, 20 bp, Artificial Sequence
  Description of Artificial Sequence: Synthetic oligonucleotide
  Target: ATXN1; (-) strand; PAM type: NNGRRT; PAM sequence: CAGGGT
cagcgttcgccttatttgaa

SEQ ID NO: 17039 - DNA, 20 bp, Artificial Sequence
  Description of Artificial Sequence: Synthetic oligonucleotide
  Target: ATXN1; (-) strand; PAM type: NNGRRT; PAM sequence: GAGGAT
catgctgttgtgtggttgga

SEQ ID NO: 17040 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ctactcctttcctcccgaac

SEQ ID NO: 17041 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tttagacaaattaaatttaa

SEQ ID NO: 17042 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atatgaaagaaagggtctga

SEQ ID NO: 17043 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gagaattctcatatgaaaga

SEQ ID NO: 17044 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tccatttattctactctttt

SEQ ID NO: 17045 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cgtgagccactgcccccagt

SEQ ID NO: 17046 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctaagcctcccaaagtgt

SEQ ID NO: 17047 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttggtagaga

SEQ ID NO: 17048 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gcctcagcctcctgagtagc

SEQ ID NO: 17049 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gattctcctgcctcagcctc

SEQ ID NO: 17050 - DNA, 20 bp, Artificial Sequence
  Description of Artificial Sequence: Synthetic oligonucleotide
  Target: ATXN1; (-) strand; PAM type: NNGRRT; PAM sequence: AGGGAT
acctctgcttcccaggttca

SEQ ID NO: 17051 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctctctctgtcacccacgc

SEQ ID NO: 17052 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ccttttttttttttttgaga

SEQ ID NO: 17053 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttcatccctagctcatatgc

SEQ ID NO: 17054 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tgtcctacgtttatgggctc

SEQ ID NO: 17055 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atcacataggtgtcttcaat

SEQ ID NO: 17056 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ttcctcccacatgactccag

SEQ ID NO: 17057 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tatttctgtctctttctctt

SEQ ID NO: 17058 - DNA, 20 bp, Artificial Sequence
  Description of Artificial Sequence: Synthetic oligonucleotide
  Target: ATXN1; (-) strand; PAM type: NNGRRT; PAM sequence: TAGAGT
aaaaaggaaaagcagtgacc

SEQ ID NO: 17059 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctggcacacgtgcacattgt

SEQ ID NO: 17060 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgccgtgcatcagaagaaat

SEQ ID NO: 17061 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ctgtgtggttttgtatagct

SEQ ID NO: 17062 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgcagtgctttccagcttag

SEQ ID NO: 17063 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttttaaaaaattatagagta

SEQ ID NO: 17064 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gcgagatttttaaaaaatta

SEQ ID NO: 17065 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tctaaaaggatgtcaggtgg

SEQ ID NO: 17066 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gactttgagcctttgtctaa

SEQ ID NO: 17067 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gatgggagcgagggctgttt

SEQ ID NO: 17068 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gagcagaaaggtattaccga

SEQ ID NO: 17069 - DNA, 20 bp, Artificial Sequence
  Description of Artificial Sequence: Synthetic oligonucleotide
  Target: ATXN1; (-) strand; PAM type: NNGRRT; PAM sequence: CCGAGT
tggcgagcagaaaggtatta

SEQ ID NO: 17070 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttggagaagttgtggcaatc

SEQ ID NO: 17071 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtggctccagccctggtaga

SEQ ID NO: 17072 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tgctgcttctggtgcacctc

SEQ ID NO: 17073 - DNA, 20 bp, Artificial Sequence
  Description of Artificial Sequence: Synthetic oligonucleotide
  Target: ATXN1; (-) strand; PAM type: NNGRRT; PAM sequence: TTGGAT
cagcaagggcatgcctggtc

SEQ ID NO: 17074 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cacagtggtggattcaggat

SEQ ID NO: 17075 - DNA, 20 bp, Artificial Sequence
  Description of Artificial Sequence: Synthetic oligonucleotide
  Target: ATXN1; (-) strand; PAM type: NNGRRT; PAM sequence: CAGGAT
acagtgcacagtggtggatt

SEQ ID NO: 17076 - DNA, 20 bp, Artificial Sequence
  Description of Artificial Sequence: Synthetic oligonucleotide
  Target: ATXN1; (-) strand; PAM type: NNGRRT; PAM sequence: GTGGAT
agcacctacagtgcacagtg

SEQ ID NO: 17077 - DNA, 20 bp, Artificial Sequence
  Description of Artificial Sequence: Synthetic oligonucleotide
  Target: ATXN1; (-) strand; PAM type: NNGRRT; PAM sequence: AAGGAT
agagcggtcccgctgctgaa

SEQ ID NO: 17078 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gctacccttggcagtttatt

SEQ ID NO: 17079 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gcaggctaggagaaagatct

SEQ ID NO: 17080 - DNA, 20 bp, Artificial Sequence
  Description of Artificial Sequence: Synthetic oligonucleotide
  Target: ATXN1; (-) strand; PAM type: NNGRRT; PAM sequence: TGGGAT
caggagcccctgactaagat

SEQ ID NO: 17081 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cttcagttgccaagcttttt

SEQ ID NO: 17082 - DNA, 20 bp, Artificial Sequence
  Description of Artificial Sequence: Synthetic oligonucleotide
  Target: ATXN1; (-) strand; PAM type: NNGRRT; PAM sequence: GAGGGT
cctaagcaacatcaagccat

SEQ ID NO: 17083 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ttgcctcctctcccacagca

SEQ ID NO: 17084 - DNA, 20 bp, Artificial Sequence
  Description of Artificial Sequence: Synthetic oligonucleotide
  Target: ATXN1; (-) strand; PAM type: NNGRRT; PAM sequence: GAGAAT
acttttgcacactgaggttt

SEQ ID NO: 17085 - DNA, 20 bp, Artificial Sequence
  Description of Artificial Sequence: Synthetic oligonucleotide
  Target: ATXN1; (-) strand; PAM type: NNGRRT; PAM sequence: GGGGAT
gcttatgaatcagaagttct

SEQ ID NO: 17086 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gattcagcaacaccaggctt

SEQ ID NO: 17087 - DNA, 20 bp, Artificial Sequence
  Description of Artificial Sequence: Synthetic oligonucleotide
  Target: ATXN1; (-) strand; PAM type: NNGRRT; PAM sequence: TTGGAT
acctcctgcttccgaatctc

SEQ ID NO: 17088 - DNA, 20 bp, Artificial Sequence
  Description of Artificial Sequence: Synthetic oligonucleotide
  Target: ATXN1; (-) strand; PAM type: NNGRRT; PAM sequence: CCGAAT
aatcccagtacctcctgctt

SEQ ID NO: 17089 - DNA, 20 bp, Artificial Sequence
  Description of Artificial Sequence: Synthetic oligonucleotide
  Target: ATXN1; (-) strand; PAM type: NNGRRT; PAM sequence: AAGGGT
atcacagaccagtgtttccc

SEQ ID NO: 17090 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gttgcacatggcttcaaggc

SEQ ID NO: 17091 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tgccatcagcacaattgcac

SEQ ID NO: 17092 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gtactgctgtgcattactct

SEQ ID NO: 17093 - DNA, 20 bp, Artificial Sequence
  Description of Artificial Sequence: Synthetic oligonucleotide
  Target: ATXN1; (-) strand; PAM type: NNGRRT; PAM sequence: CAGAAT
catttagggcctgcttctta

SEQ ID NO: 17094 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tggggtttcaccatgttggc

SEQ ID NO: 17095 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttctatttttagtagaaa

SEQ ID NO: 17096 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcctgagtagc

SEQ ID NO: 17097 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aattctcttgcctcagcctc

SEQ ID NO: 17098 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgggtctgttgctaggc

SEQ ID NO: 17099 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tttttttttaaggcagagtc

SEQ ID NO: 17100 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttttttttttttttttaagg

SEQ ID NO: 17101 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tgtcacttacaaagtcttcc

SEQ ID NO: 17102 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gccatggccactttgtcatg

SEQ ID NO: 17103 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tatgaagtgcaggaaaccac

SEQ ID NO: 17104 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gccttcaagtgatgcattat

SEQ ID NO: 17105 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tccccacactttgttttacg

SEQ ID NO: 17106 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ccggccagcctgttaaccct

SEQ ID NO: 17107 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ctgtcctttgtttttcttta

SEQ ID NO: 17108 - DNA, 20 bp, Artificial Sequence
  Description of Artificial Sequence: Synthetic oligonucleotide
  Target: ATXN1; (-) strand; PAM type: NNGRRT; PAM sequence: CTGAAT
catgcaccactgtgcctggc

SEQ ID NO: 17109 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccttggcctctcaaagtgc

SEQ ID NO: 17110 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ggtacacacagcttcagggc

SEQ ID NO: 17111 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gtgtttgtcatcacgccatc

SEQ ID NO: 17112 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tgtcattcataaagtcttca

SEQ ID NO: 17113 - DNA, 20 bp, Artificial Sequence
  Description of Artificial Sequence: Synthetic oligonucleotide
  Target: ATXN1; (-) strand; PAM type: NNGRRT; PAM sequence: CGGGGT
atttatttatttatttgaga

SEQ ID NO: 17114 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaaatgtggcacagtgcttt

SEQ ID NO: 17115 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaaagtgc

SEQ ID NO: 17116 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tggggtttcaccatgttagc

SEQ ID NO: 17117 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttagtagagc

SEQ ID NO: 17118 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattctcctgcctcaacctc

SEQ ID NO: 17119 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtcttgctctgtcaccaggc

SEQ ID NO: 17120 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tgttttttttttttttgaga

SEQ ID NO: 17121 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ggaaaggagccaggtcctcg

SEQ ID NO: 17122 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ccacttcagttcttgcccaa

SEQ ID NO: 17123 - DNA, 20 bp, Artificial Sequence
  Description of Artificial Sequence: Synthetic oligonucleotide
  Target: ATXN1; (-) strand; PAM type: NNGRRT; PAM sequence: ATGAAT
attcagttccctctagtgca

SEQ ID NO: 17124 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttcatgatattacctggaag

SEQ ID NO: 17125 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ccaacataatgtggacttcc

SEQ ID NO: 17126 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gacagtcttagtctgggggt

SEQ ID NO: 17127 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttgaatgacagtcttagtct

SEQ ID NO: 17128 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttttaagtatacatgggccc

SEQ ID NO: 17129 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tcctgttcagcaaacattta

SEQ ID NO: 17130 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tgggcaaggtgaaagatgat

SEQ ID NO: 17131 - DNA, 20 bp, Artificial Sequence
  Description of Artificial Sequence: Synthetic oligonucleotide
  Target: ATXN1; (-) strand; PAM type: NNGRRT; PAM sequence: TAGGGT
cgtatagcgcaggcgtgtag

SEQ ID NO: 17132 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tacttgggaggctgaggcag

SEQ ID NO: 17133 - DNA, 20 bp, Artificial Sequence
  Description of Artificial Sequence: Synthetic oligonucleotide
  Target: ATXN1; (-) strand; PAM type: NNGRRT; PAM sequence: CCGGGT
gaatacaaaaaaaaaattag

SEQ ID NO: 17134 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ggtgaaaccctgtctctact

SEQ ID NO: 17135 - DNA, 20 bp, Artificial Sequence
  Description of Artificial Sequence: Synthetic oligonucleotide
  Target: ATXN1; (-) strand; PAM type: NNGRRT; PAM sequence: GCGGAT
actttgggaggccgaggcgc

SEQ ID NO: 17136 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cataagattataatactggg

SEQ ID NO: 17137 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ccattttagctgaaaacata

SEQ ID NO: 17138 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gcagaatagtatgatctgaa

SEQ ID NO: 17139 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aacttgcagaatagtatgat

SEQ ID NO: 17140 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtgtttgtttctgaaacttg

SEQ ID NO: 17141 - DNA, 20 bp, Artificial Sequence
  Description of Artificial Sequence: Synthetic oligonucleotide
  Target: ATXN1; (-) strand; PAM type: NNGRRT; PAM sequence: ACGGAT
aagagtggatttcagcctgc

SEQ ID NO: 17142 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ccaggaacaagagagaaaga

SEQ ID NO: 17143 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cagaccaggaacaagagaga

SEQ ID NO: 17144 - DNA, 20 bp, Artificial Sequence
  Description of Artificial Sequence: Synthetic oligonucleotide
  Target: ATXN1; (-) strand; PAM type: NNGRRT; PAM sequence: AAGAGT
agcatactggagcatagtga

SEQ ID NO: 17145 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gaaaggccagggatttcccc

SEQ ID NO: 17146 - DNA, 20 bp, Artificial Sequence
  Description of Artificial Sequence: Synthetic oligonucleotide
  Target: ATXN1; (-) strand; PAM type: NNGRRT; PAM sequence: AGGGAT
atatacatttgagaaaggcc

SEQ ID NO: 17147 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tctttaatcacttagacgta

SEQ ID NO: 17148 - DNA, 20 bp, Artificial Sequence
  Description of Artificial Sequence: Synthetic oligonucleotide
  Target: ATXN1; (-) strand; PAM type: NNGRRT; PAM sequence: CTGAGT
attcacatcagttgattagt

SEQ ID NO: 17149 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gggtggagaaagtatttatc

SEQ ID NO: 17150 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agtaactactgcttttcagc

SEQ ID NO: 17151 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ctttatcagctgctctgagt

SEQ ID NO: 17152 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tgtaggctttatcagctgct

SEQ ID NO: 17153 - DNA, 20 bp, Artificial Sequence
  Description of Artificial Sequence: Synthetic oligonucleotide
  Target: ATXN1; (-) strand; PAM type: NNGRRT; PAM sequence: CAGAGT
caaggcagaaaggaactttt

SEQ ID NO: 17154 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gtcaaaaaacaaacagtggg

SEQ ID NO: 17155 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cattgtcaaaaaacaaacag

SEQ ID NO: 17156 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gatgggttttcaacatagat

SEQ ID NO: 17157 - DNA, 20 bp, Artificial Sequence
  Description of Artificial Sequence: Synthetic oligonucleotide
  Target: ATXN1; (-) strand; PAM type: NNGRRT; PAM sequence: ATGGGT
aactggatgacagtcagccg

SEQ ID NO: 17158 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tggccaccatactcagggaa

SEQ ID NO: 17159 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ctttggagatttatggagtt

SEQ ID NO: 17160 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtgggacctttggagattta

SEQ ID NO: 17161 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atagttacagaaggctttca

SEQ ID NO: 17162 - DNA, 20 bp, Artificial Sequence
  Description of Artificial Sequence: Synthetic oligonucleotide
  Target: ATXN1; (-) strand; PAM type: NNGRRT; PAM sequence: AGGAAT
caaaagtttttagtgttccc

SEQ ID NO: 17163 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcctccggctagatggaaaa

SEQ ID NO: 17164 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tccttacaaccccattttct

SEQ ID NO: 17165 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cttacacatttgagtgggag

SEQ ID NO: 17166 - DNA, 20 bp, Artificial Sequence
  Description of Artificial Sequence: Synthetic oligonucleotide
  Target: ATXN1; (-) strand; PAM type: NNGRRT; PAM sequence: TTGAGT
cagtatgttgccttacacat

SEQ ID NO: 17167 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tcaaggacctcttccaatta

SEQ ID NO: 17168 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ggttcctttgcagaagacat

SEQ ID NO: 17169 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aaagaggtatgtcaacctcc

SEQ ID NO: 17170 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgagcatgagtggttgaacc

SEQ ID NO: 17171 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tccattaagcgtcaatgagc

SEQ ID NO: 17172 - DNA, 20 bp, Artificial Sequence
  Description of Artificial Sequence: Synthetic oligonucleotide
  Target: ATXN1; (-) strand; PAM type: NNGRRT; PAM sequence: ATGAGT
accgcattacatttcattaa

SEQ ID NO: 17173 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tggcaaaaacaaaacagaaa

SEQ ID NO: 17174 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gaaaataatataatccagaa

SEQ ID NO: 17175 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tccttattttttttttctgt

SEQ ID NO: 17176 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tggaaaatattgtcacttag

SEQ ID NO: 17177 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tcacatctacagatataagt

SEQ ID NO: 17178 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggtcagcgataaatcacaga

SEQ ID NO: 17179 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgaaggtcagcgataaatca

SEQ ID NO: 17180 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttcagttgttttcttttgat

SEQ ID NO: 17181 - DNA, 20 bp, Artificial Sequence
  Description of Artificial Sequence: Synthetic oligonucleotide
  Target: ATXN1; (-) strand; PAM type: NNGRRT; PAM sequence: TAGAAT
attgcttaaaaagaagtgtg

SEQ ID NO: 17182 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tattattaacggtattgata

SEQ ID NO: 17183 - DNA, 20 bp, Artificial Sequence
  Description of Artificial Sequence: Synthetic oligonucleotide
  Target: ATXN1; (-) strand; PAM type: NNGRRT; PAM sequence: AGGGAT
acttcaaatggtaaacaaga

SEQ ID NO: 17184 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tcacatatgcaggcatatct

SEQ ID NO: 17185 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tatcaaattggaaaaccctc

SEQ ID NO: 17186 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgtaaaaacaaattataatt

SEQ ID NO: 17187 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tttgaataaagatatactta

SEQ ID NO: 17188 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgtgtctaattgttgcattt

SEQ ID NO: 17189 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aaaataaacctcttttttcc

SEQ ID NO: 17190 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcactccactgcactccagc

SEQ ID NO: 17191 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggagcctgaggcag

SEQ ID NO: 17192 - DNA, 20 bp, Artificial Sequence
  Description of Artificial Sequence: Synthetic oligonucleotide
  Target: ATXN1; (-) strand; PAM type: NNGRRT; PAM sequence: CTGGGT
actaaaaatacaaaaattag

SEQ ID NO: 17193 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agcgggtgaatcacgaggtc

SEQ ID NO: 17194 - DNA, 20 bp, Artificial Sequence
  Description of Artificial Sequence: Synthetic oligonucleotide
  Target: ATXN1; (-) strand; PAM type: NNGRRT; PAM sequence: GTGAAT
actttgggaggtcaaagcgg

SEQ ID NO: 17195 - DNA, 20 bp, Artificial Sequence
  Description of Artificial Sequence: Synthetic oligonucleotide
  Target: ATXN1; (-) strand; PAM type: NNGRRT; PAM sequence: GCGGGT
cagcactttgggaggtcaaa

SEQ ID NO: 17196 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tatatgtttagttatatatc

SEQ ID NO: 17197 - DNA, 20 bp, Artificial Sequence
  Description of Artificial Sequence: Synthetic oligonucleotide
  Target: ATXN1; (-) strand; PAM type: NNGRRT; PAM sequence: TGGGAT
agggcatgaattccaagagg

SEQ ID NO: 17198 - DNA, 20 bp, Artificial Sequence
  Description of Artificial Sequence: Synthetic oligonucleotide
  Target: ATXN1; (-) strand; PAM type: NNGRRT; PAM sequence: ATGAAT
caagaaggctttacaagggc

SEQ ID NO: 17199 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ccacagtctgtttgctagaa

SEQ ID NO: 17200 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ctttgccacagtctgtttgc

SEQ ID NO: 17201 - DNA, 20 bp, Artificial Sequence
  Description of Artificial Sequence: Synthetic oligonucleotide
  Target: ATXN1; (-) strand; PAM type: NNGRRT; PAM sequence: GAGGAT
cccaggtgagtaacccagaa

SEQ ID NO: 17202 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tggcagtcagcctcccccag

SEQ ID NO: 17203 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aaggatagggtgggggcggt

SEQ ID NO: 17204 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ctgacgtttcatctgaagga

SEQ ID NO: 17205 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ctgggctgacgtttcatctg

SEQ ID NO: 17206 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgaatcactgcatatcatag

SEQ ID NO: 17207 - DNA, 20 bp, Artificial Sequence
  Description of Artificial Sequence: Synthetic oligonucleotide
  Target: ATXN1; (-) strand; PAM type: NNGRRT; PAM sequence: GTGAAT
atctctcagtttttctaagt

SEQ ID NO: 17208 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aagtcatgtaaagttcccag

SEQ ID NO: 17209 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tggagtcagatggcctgagt

SEQ ID NO: 17210 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggtttctggagtcagatggc

SEQ ID NO: 17211 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gggattaagaacctggtttc

SEQ ID NO: 17212 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ttaaaggggtagtgtgatgc

SEQ ID NO: 17213 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gtaggaaaaatggttcttaa

SEQ ID NO: 17214 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggaggctgaggcag

SEQ ID NO: 17215 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ccagcagatcacctgaggtc

SEQ ID NO: 17216 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ttaagaagcctgatgaatgg

SEQ ID NO: 17217 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gtggcaggttaagaagcctg

SEQ ID NO: 17218 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agttaaggtatcaaagatgc

SEQ ID NO: 17219 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctttctgttttctttgacaa

SEQ ID NO: 17220 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tcttgttcttttccttacca

SEQ ID NO: 17221 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgcttgggaggctgaggcag

SEQ ID NO: 17222 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggtggatcacctgaggtc

SEQ ID NO: 17223 - DNA, 20 bp, Artificial Sequence
  Description of Artificial Sequence: Synthetic oligonucleotide
  Target: ATXN1; (-) strand; PAM type: NNGRRT; PAM sequence: GTGGAT
acttcgggaggccgaggtgg

SEQ ID NO: 17224 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tagcacttcgggaggccgag

SEQ ID NO: 17225 - DNA, 20 bp, Artificial Sequence
  Description of Artificial Sequence: Synthetic oligonucleotide
  Target: ATXN1; (-) strand; PAM type: NNGRRT; PAM sequence: TTGAAT
actgaaacacttcgtacagt

SEQ ID NO: 17226 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tcacatgtctatgccacaga

SEQ ID NO: 17227 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tattgaggcaggagtgcagc

SEQ ID NO: 17228 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ttctaaatttgtattgaggc

SEQ ID NO: 17229 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggaggactgcttgagttg

SEQ ID NO: 17230 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ggctgagctgggaggactgc

SEQ ID NO: 17231 - DNA, 20 bp, Artificial Sequence
  Description of Artificial Sequence: Synthetic oligonucleotide
  Target: ATXN1; (-) strand; PAM type: NNGRRT; PAM sequence: ATGGGT
catgttcctggccggacatg

SEQ ID NO: 17232 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ataaagaatattccatcagt

SEQ ID NO: 17233 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ctaagagtcagaccaaaata

SEQ ID NO: 17234 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttggttgtgggtacaatcct

SEQ ID NO: 17235 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tgctttagtttccattggtt

SEQ ID NO: 17236 - DNA, 20 bp, Artificial Sequence
  Description of Artificial Sequence: Synthetic oligonucleotide
  Target: ATXN1; (-) strand; PAM type: NNGRRT; PAM sequence: GTGGGT
agaaagatttagaaatggca

SEQ ID NO: 17237 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tttaataaaacacagtcact

SEQ ID NO: 17238 - DNA, 20 bp, Artificial Sequence
  Description of Artificial Sequence: Synthetic oligonucleotide
  Target: ATXN1; (-) strand; PAM type: NNGRRT; PAM sequence: GCGAAT
gaggcctataaaattcactt

SEQ ID NO: 17239 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cacaacataatgttccacaa

SEQ ID NO: 17240 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aaaatatattttgggcctag

SEQ ID NO: 17241 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tggggtcctcaataaatttt

SEQ ID NO: 17242 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ctacctaatgaaaagttcct

SEQ ID NO: 17243 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tatttctattaaatgaacta

SEQ ID NO: 17244 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gttatttcatgtagtatgca

SEQ ID NO: 17245 - DNA, 20 bp, Artificial Sequence
  Description of Artificial Sequence: Synthetic oligonucleotide
  Target: ATXN1; (-) strand; PAM type: NNGRRT; PAM sequence: ATGGAT
agagagctgcaaaaatctaa

SEQ ID NO: 17246 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ctgaattcagaggcacagaa

SEQ ID NO: 17247 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aaacaacatatcacagaaaa

SEQ ID NO: 17248 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gttttggtatgatataaaaa

SEQ ID NO: 17249 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ctttaagaaactaccactta

SEQ ID NO: 17250 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttttaatataaaagaatact

SEQ ID NO: 17251 - DNA, 20 bp, Artificial Sequence
  Description of Artificial Sequence: Synthetic oligonucleotide
  Target: ATXN1; (-) strand; PAM type: NNGRRT; PAM sequence: AAGAAT
actaatgaattttaatataa

SEQ ID NO: 17252 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ccaaagttcaagatagacta

SEQ ID NO: 17253 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aatataattttccaaatgac

SEQ ID NO: 17254 - DNA, 20 bp, Artificial Sequence
  Description of Artificial Sequence: Synthetic oligonucleotide
  Target: ATXN1; (-) strand; PAM type: NNGRRT; PAM sequence: CGGAGT
attctcttccatgtgtacag

SEQ ID NO: 17255 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cagtagggatctgtggggtt

SEQ ID NO: 17256 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttacttccagtagggatctg

SEQ ID NO: 17257 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tctgtgcttttacttccagt

SEQ ID NO: 17258 - DNA, 20 bp, Artificial Sequence
  Description of Artificial Sequence: Synthetic oligonucleotide
  Target: ATXN1; (-) strand; PAM type: NNGRRT; PAM sequence: TAGAGT
attgaggccagaaggaaacc

SEQ ID NO: 17259 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tccccaagaggacaaatggt

SEQ ID NO: 17260 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tatctcatgttcttgaccac

SEQ ID NO: 17261 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tctcacagtttcttgcctag

SEQ ID NO: 17262 - DNA, 20 bp, Artificial Sequence
  Description of Artificial Sequence: Synthetic oligonucleotide
  Target: ATXN1; (-) strand; PAM type: NNGRRT; PAM sequence: ATGGGT
taacaaaaagaaatgaagtg

SEQ ID NO: 17263 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aataactagaggaatgaatt

SEQ ID NO: 17264 - DNA, 20 bp, Artificial Sequence
  Description of Artificial Sequence: Synthetic oligonucleotide
  Target: ATXN1; (-) strand; PAM type: NNGRRT; PAM sequence: ATGAAT
atttcaaaataactagagga

SEQ ID NO: 17265 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gtatatttcaaaataactag

SEQ ID NO: 17266 - DNA, 20 bp, Artificial Sequence
  Description of Artificial Sequence: Synthetic oligonucleotide
  Target: ATXN1; (-) strand; PAM type: NNGRRT; PAM sequence: AGGAAT
taaaaatatagttagatagt

SEQ ID NO: 17267 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ggaaagggtagtgaggaggg

SEQ ID NO: 17268 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gatggttagcagaggatgga

SEQ ID NO: 17269 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gagtagaatgatggttagca

SEQ ID NO: 17270 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gacgtcatggagacagagag

SEQ ID NO: 17271 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aacatgacgtcatggagaca

SEQ ID NO: 17272 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aatattattcagccatacaa

SEQ ID NO: 17273 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aataaggtacatatacacag

SEQ ID NO: 17274 - DNA, 20 bp, Artificial Sequence
  Description of Artificial Sequence: Synthetic oligonucleotide
  Target: ATXN1; (-) strand; PAM type: NNGRRT; PAM sequence: ATGGAT
aagtctccatcaatgaagga

SEQ ID NO: 17275 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atctaagtctccatcaatga

SEQ ID NO: 17276 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tattcattatagccaagata

SEQ ID NO: 17277 - DNA, 20 bp, Artificial Sequence
  Description of Artificial Sequence: Synthetic oligonucleotide
  Target: ATXN1; (-) strand; PAM type: NNGRRT; PAM sequence: GGGAGT
caggagaatcactggaacca

SEQ ID NO: 17278 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcgggaggctgaggcag

SEQ ID NO: 17279 - DNA, 20 bp, Artificial Sequence
  Description of Artificial Sequence: Synthetic oligonucleotide
  Target: ATXN1; (-) strand; PAM type: NNGRRT; PAM sequence: CTGAGT
actataaatgcaaaaagtaa

SEQ ID NO: 17280 - DNA, 20 bp, Artificial Sequence
  Description of Artificial Sequence: Synthetic oligonucleotide
  Target: ATXN1; (-) strand; PAM type: NNGRRT; PAM sequence: ACGGAT
actttgggagaccgaggcga

SEQ ID NO: 17281 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgctaaaaaaaaagtcatgg

SEQ ID NO: 17282 - DNA, 20 bp, Artificial Sequence
  Description of Artificial Sequence: Synthetic oligonucleotide
  Target: ATXN1; (-) strand; PAM type: NNGRRT; PAM sequence: CTGAAT
atttcatgaaaaaggtcttt

SEQ ID NO: 17283 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ataatttacctagttacttc

SEQ ID NO: 17284 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gaaactcaagggcttaacat

SEQ ID NO: 17285 - DNA, 20 bp, Artificial Sequence
  Description of Artificial Sequence: Synthetic oligonucleotide
  Target: ATXN1; (-) strand; PAM type: NNGRRT; PAM sequence: TAGGAT
taataaaagtgtccactgcc

SEQ ID NO: 17286 - DNA, 20 bp, Artificial Sequence
  Description of Artificial Sequence: Synthetic oligonucleotide
  Target: ATXN1; (-) strand; PAM type: NNGRRT; PAM sequence: GCGGGT
atttctttatttattagaag

SEQ ID NO: 17287 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gagtcctcaatctgtcactt

SEQ ID NO: 17288 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gctctcaggtggatggaggt

SEQ ID NO: 17289 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tagagaatctttgctctcag

SEQ ID NO: 17290 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggcagcagactgaggagata

SEQ ID NO: 17291 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgtggaatacctgccagagg

SEQ ID NO: 17292 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aagaggatgtttcatgattg

SEQ ID NO: 17293 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ctttgaaacaagaaagtgaa

SEQ ID NO: 17294 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ttaccgacacgtacatattt

SEQ ID NO: 17295 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ggtctgctttggggaggcaa

SEQ ID NO: 17296 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cagaatccagcgtgtggctt

SEQ ID NO: 17297 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aatcaaaagttttaacctca

SEQ ID NO: 17298 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ctctatcctcatgtccttct

SEQ ID NO: 17299 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cgggctgggctgaggatacc

SEQ ID NO: 17300 - DNA, 20 bp, Artificial Sequence
  Description of Artificial Sequence: Synthetic oligonucleotide
  Target: ATXN1; (-) strand; PAM type: NNGRRT; PAM sequence: GAGGAT
caggggattcgggctgggct

SEQ ID NO: 17301 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tgctttcagaggaataaaca

SEQ ID NO: 17302 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tttcataaatgtgctttcag

SEQ ID NO: 17303 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gcgtttagaaagcacttcaa

SEQ ID NO: 17304 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tggtgaatcaactgacccaa

SEQ ID NO: 17305 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aaaggggacagaggtggatg

SEQ ID NO: 17306 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aataagcaaaggggacagag

SEQ ID NO: 17307 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tcagtatgtttttaacgatt

SEQ ID NO: 17308 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ccgggcattgaaaaatgact

SEQ ID NO: 17309 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ggcccgaggcactttgggga

SEQ ID NO: 17310 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ataggtaagcccaccttgat

SEQ ID NO: 17311 - DNA, 20 bp, Artificial Sequence
  Description of Artificial Sequence: Synthetic oligonucleotide
  Target: ATXN1; (-) strand; PAM type: NNGRRT; PAM sequence: GGGGGT
acaaatgaggcaacattaca

SEQ ID NO: 17312 - DNA, 20 bp, Artificial Sequence
  Description of Artificial Sequence: Synthetic oligonucleotide
  Target: ATXN1; (-) strand; PAM type: NNGRRT; PAM sequence: ACGAGT
gatatacctaatgctaaatg

SEQ ID NO: 17313 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gtggggttgggggagggggg

SEQ ID NO: 17314 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcacacactggggcctgttg

SEQ ID NO: 17315 - DNA, 20 bp, Artificial Sequence
  Description of Artificial Sequence: Synthetic oligonucleotide
  Target: ATXN1; (-) strand; PAM type: NNGRRT; PAM sequence: AAGAGT
atggctgagaattttttgcc

SEQ ID NO: 17316 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggatgtcattaagaatggct

SEQ ID NO: 17317 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ctggaggtatggatgtcatt

SEQ ID NO: 17318 - DNA, 20 bp, Artificial Sequence
  Description of Artificial Sequence: Synthetic oligonucleotide
  Target: ATXN1; (-) strand; PAM type: NNGRRT; PAM sequence: ATGGAT
cagggcatggaactggaggt

SEQ ID NO: 17319 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggaggattgcttgaggcc

SEQ ID NO: 17320 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tacccaggaggccaaggtgg

SEQ ID NO: 17321 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tatgatgccaagaaaatggg

SEQ ID NO: 17322 - DNA, 20 bp, Artificial Sequence
  Description of Artificial Sequence: Synthetic oligonucleotide
  Target: ATXN1; (-) strand; PAM type: NNGRRT; PAM sequence: TGGGGT
taattatgatgccaagaaaa

SEQ ID NO: 17323 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gtgtacagcacaatttctca

SEQ ID NO: 17324 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gtgagtttgacatactatgg

SEQ ID NO: 17325 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ggaggagaaggaaatgcctc

SEQ ID NO: 17326 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ttggtttgtctgagagaaag

SEQ ID NO: 17327 - DNA, 20 bp, Artificial Sequence
  Description of Artificial Sequence: Synthetic oligonucleotide
  Target: ATXN1; (-) strand; PAM type: NNGRRT; PAM sequence: TAGAGT
cagtcattaggaataagcat

SEQ ID NO: 17328 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gaaagtctatcacagtcatt

SEQ ID NO: 17329 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tatacaaaaaagggtaagat

SEQ ID NO: 17330 - DNA, 20 bp, Artificial Sequence
  Description of Artificial Sequence: Synthetic oligonucleotide
  Target: ATXN1; (-) strand; PAM type: NNGRRT; PAM sequence: AAGGGT
caagagtgatgtatacaaaa

SEQ ID NO: 17331 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ggttgttgaaaatttccacc

SEQ ID NO: 17332 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aacatcaggaaacatgacta

SEQ ID NO: 17333 - DNA, 20 bp, Artificial Sequence
  Description of Artificial Sequence: Synthetic oligonucleotide
  Target: ATXN1; (-) strand; PAM type: NNGRRT; PAM sequence: CCGGAT
gagcacaccaagggggtctg

SEQ ID NO: 17334 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tttgtagtagagcacaccaa

SEQ ID NO: 17335 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aaaacctagatgacgggttg

SEQ ID NO: 17336 - DNA, 20 bp, Artificial Sequence
  Description of Artificial Sequence: Synthetic oligonucleotide
  Target: ATXN1; (-) strand; PAM type: NNGRRT; PAM sequence: ACGGGT
tggggcttaaaacctagatg

SEQ ID NO: 17337 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttaatatattttgctgactg

SEQ ID NO: 17338 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgaatgtggaggtaggcaac

SEQ ID NO: 17339 - DNA, 20 bp, Artificial Sequence
  Description of Artificial Sequence: Synthetic oligonucleotide
  Target: ATXN1; (-) strand; PAM type: NNGRRT; PAM sequence: GTGAAT
agggagtagacatcaccaat

SEQ ID NO: 17340 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ggtgctcaggagtgaggaca

SEQ ID NO: 17341 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gtctgaggtgacaggtgctc

SEQ ID NO: 17342 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cctttcttggttgggggtca

SEQ ID NO: 17343 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tggcttaccctttcttggtt

SEQ ID NO: 17344 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ccacagaagtgaccagaccc

SEQ ID NO: 17345 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gttgggccacttagtgatat

SEQ ID NO: 17346 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tggaataagggggaaggcag

SEQ ID NO: 17347 - DNA, 20 bp, Artificial Sequence
  Description of Artificial Sequence: Synthetic oligonucleotide
  Target: ATXN1; (-) strand; PAM type: NNGRRT; PAM sequence: TGGAAT
atttggtccctgctgacctg

SEQ ID NO: 17348 - DNA, 20 bp, Artificial Sequence
  Description of Artificial Sequence: Synthetic oligonucleotide
  Target: ATXN1; (-) strand; PAM type: NNGRRT; PAM sequence: TAGGAT
taaccaggaaatagaattga

SEQ ID NO: 17349 - DNA, 20 bp, Artificial Sequence
  Description of Artificial Sequence: Synthetic oligonucleotide
  Target: ATXN1; (-) strand; PAM type: NNGRRT; PAM sequence: TAGAAT
caagtagcataaccaggaaa

SEQ ID NO: 17350 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tgctggagaggcagaaaggg

SEQ ID NO: 17351 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgggtgagagggcacgaggg

SEQ ID NO: 17352 - DNA, 20 bp, Artificial Sequence
  Description of Artificial Sequence: Synthetic oligonucleotide
  Target: ATXN1; (-) strand; PAM type: NNGRRT; PAM sequence: AGGGGT
catctgggtgagagggcacg

SEQ ID NO: 17353 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ccatgagagcaggcagacat

SEQ ID NO: 17354 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gttttcagtttggagagtac

SEQ ID NO: 17355 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tcaccatggttttcagtttg

SEQ ID NO: 17356 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tcctctttagtgatagtttg

SEQ ID NO: 17357 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tagcacagaggaagatcgca

SEQ ID NO: 17358 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aagtaaaaacggaaggaaat

SEQ ID NO: 17359 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tttaatgattaaaagtcaaa

SEQ ID NO: 17360 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tgcctcacaggacatgcttc

SEQ ID NO: 17361 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gcctgacttctagtagtgtt

SEQ ID NO: 17362 - DNA, 20 bp, Artificial Sequence
  Description of Artificial Sequence: Synthetic oligonucleotide
  Target: ATXN1; (-) strand; PAM type: NNGRRT; PAM sequence: TTGAGT
catcgaaatgaaatataaaa

SEQ ID NO: 17363 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tagagtaaatggactgtaat

SEQ ID NO: 17364 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tcatgctatcaaaaattagc

SEQ ID NO: 17365 - DNA, 20 bp, Artificial Sequence
  Description of Artificial Sequence: Synthetic oligonucleotide
  Target: ATXN1; (-) strand; PAM type: NNGRRT; PAM sequence: CAGAAT
acttttataaaagcaaattt

SEQ ID NO: 17366 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tcttattacaaactacctgg

SEQ ID NO: 17367 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtacatgctttcctccctgc

SEQ ID NO: 17368 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cctgaggcccactttcttac

SEQ ID NO: 17369 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tcacttcagaaatagacact

SEQ ID NO: 17370 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgggaatgttaatagactct

SEQ ID NO: 17371 - DNA, 20 bp, Artificial Sequence
  Description of Artificial Sequence: Synthetic oligonucleotide
  Target: ATXN1; (-) strand; PAM type: NNGRRT; PAM sequence: GGGAAT
agtaagaactaatgactctt

SEQ ID NO: 17372 - DNA, 20 bp, Artificial Sequence
  Description of Artificial Sequence: Synthetic oligonucleotide
  Target: ATXN1; (-) strand; PAM type: NNGRRT; PAM sequence: TCGAAT
tgattttgacccttgattgt

SEQ ID NO: 17373 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gtcatttcagttacatgtca

SEQ ID NO: 17374 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ataatactgatgttagaggt

SEQ ID NO: 17375 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ataggtcaggggtggggccc

SEQ ID NO: 17376 - DNA, 20 bp, Artificial Sequence
  Description of Artificial Sequence: Synthetic oligonucleotide
  Target: ATXN1; (-) strand; PAM type: NNGRRT; PAM sequence: AGGGGT
taaagtatgttaaataggtc

SEQ ID NO: 17377 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tagaccagaggccctaggac

SEQ ID NO: 17378 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gcaaagacacatttcagtaa

SEQ ID NO: 17379 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tatgacacagaaaacatttg

SEQ ID NO: 17380 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gcaaaagaagtgttataaaa

SEQ ID NO: 17381 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ctgattctggggattaggac

SEQ ID NO: 17382 - DNA, 20 bp, Artificial Sequence
  Description of Artificial Sequence: Synthetic oligonucleotide
  Target: ATXN1; (-) strand; PAM type: NNGRRT; PAM sequence: GGGGAT
cgaattcacagactgattct

SEQ ID NO: 17383 - DNA, 20 bp, Artificial Sequence
  Description of Artificial Sequence: Synthetic oligonucleotide
  Target: ATXN1; (-) strand; PAM type: NNGRRT; PAM sequence: ACGAAT
tctgtgaaatcgcttttacc

SEQ ID NO: 17384 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tctgtgctgtgtttccatag

SEQ ID NO: 17385 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccagagtgc

SEQ ID NO: 17386 - DNA, 20 bp, Artificial Sequence
  Description of Artificial Sequence: Synthetic oligonucleotide
  Target: ATXN1; (-) strand; PAM type: NNGRRT; PAM sequence: CAGAGT
atccacccgcctcggcctcc

SEQ ID NO: 17387 - DNA, 20 bp, Artificial Sequence
  Description of Artificial Sequence: Synthetic oligonucleotide
  Target: ATXN1; (-) strand; PAM type: NNGRRT; PAM sequence: TGGGGT
attttatatttttactagag

SEQ ID NO: 17388 - DNA, 20 bp, Artificial Sequence
  Description of Artificial Sequence: Synthetic oligonucleotide
  Target: ATXN1; (-) strand; PAM type: NNGRRT; PAM sequence: TAGAGT
actaaattttatatttttac

SEQ ID NO: 17389 - DNA, 20 bp, Artificial Sequence
  Description of Artificial Sequence: Synthetic oligonucleotide
  Target: ATXN1; (-) strand; PAM type: NNGRRT; PAM sequence: GGGAGT
cctcagcctcccaagtagct

SEQ ID NO: 17390 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcattctgtcgcccaggc

SEQ ID NO: 17391 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttttttggcgggggggaa

SEQ ID NO: 17392 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cattctctgtagggactcta

SEQ ID NO: 17393 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gcctttgtgttagaggtgac

SEQ ID NO: 17394 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ttggtaaagccggaaagtat

SEQ ID NO: 17395 - DNA, 20 bp, Artificial Sequence
  Description of Artificial Sequence: Synthetic oligonucleotide
  Target: ATXN1; (-) strand; PAM type: NNGRRT; PAM sequence: TGGGAT
atttgtgccaaattaatatt

SEQ ID NO: 17396 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gcaggcgtgagtgggaagag

SEQ ID NO: 17397 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgaggaggtaagctgcaggc

SEQ ID NO: 17398 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gcccaaaatgttaatagtgc

SEQ ID NO: 17399 - DNA, 20 bp, Artificial Sequence
  Description of Artificial Sequence: Synthetic oligonucleotide
  Target: ATXN1; (-) strand; PAM type: NNGRRT; PAM sequence: AAGGAT
aacagtcctctgcctcaacc

SEQ ID NO: 17400 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tctcttgaatgaatgaatga

SEQ ID NO: 17401 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggggtctcttgaatgaatga

SEQ ID NO: 17402 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gtcaggggtctcttgaatga

SEQ ID NO: 17403 - DNA, 20 bp, Artificial Sequence
  Description of Artificial Sequence: Synthetic oligonucleotide
  Target: ATXN1; (-) strand; PAM type: NNGRRT; PAM sequence: ATGAAT
cagagtcaggggtctcttga

SEQ ID NO: 17404 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gcagcagagtcaggggtctc

SEQ ID NO: 17405 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ccagcctgggcagcagagtc

SEQ ID NO: 17406 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctacactccagcctgggcag

SEQ ID NO: 17407 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggaggatcgcctgagctc

SEQ ID NO: 17408 - DNA, 20 bp, Artificial Sequence
  Description of Artificial Sequence: Synthetic oligonucleotide
  Target: ATXN1; (-) strand; PAM type: NNGRRT; PAM sequence: GAGGAT
actttaggaggtcgaggcag

SEQ ID NO: 17409 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ggtagcaatactggcatcta

SEQ ID NO: 17410 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ctgccacatgctgtcaacca

SEQ ID NO: 17411 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aatgagaccagcagcaatgt

SEQ ID NO: 17412 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgaatccttgggagactcat

SEQ ID NO: 17413 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gttttaaaatgtcaaacaga

SEQ ID NO: 17414 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aaaagtcctgtggttgaatt

SEQ ID NO: 17415 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tttaaaaaaaagtcctgtgg

SEQ ID NO: 17416 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tgtttcccttgcctgtggct

SEQ ID NO: 17417 - DNA, 20 bp, Artificial Sequence
  Description of Artificial Sequence: Synthetic oligonucleotide
  Target: ATXN1; (-) strand; PAM type: NNGRRT; PAM sequence: GCGGGT
cttgttggctaggttgggct

SEQ ID NO: 17418 - DNA, 20 bp, Artificial Sequence
  Description of Artificial Sequence: Synthetic oligonucleotide
  Target: ATXN1; (-) strand; PAM type: NNGRRT; PAM sequence: ATGAAT
cctctgtagcagcagtatgg

SEQ ID NO: 17419 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gtcgcctctgtagcagcagt

SEQ ID NO: 17420 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggaggctgaggcag

SEQ ID NO: 17421 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ggtgggcagatcatgaggtg

SEQ ID NO: 17422 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gtgctaaaccttctgattga

SEQ ID NO: 17423 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ccatcagagccagcctttca

SEQ ID NO: 17424 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ccagtacagtggccatttcc

SEQ ID NO: 17425 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gaattcagaactacacaaaa

SEQ ID NO: 17426 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tttgaaattgaaagtctgag

SEQ ID NO: 17427 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agtctgtttaagatttcaga

SEQ ID NO: 17428 - DNA, 20 bp, Artificial Sequence
  Description of Artificial Sequence: Synthetic oligonucleotide
  Target: ATXN1; (-) strand; PAM type: NNGRRT; PAM sequence: CTGAAT
accaaaagagttgtgtgcct

SEQ ID NO: 17429 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gggctgcagctttctaccaa

SEQ ID NO: 17430 - DNA, 20 bp, Artificial Sequence
  Description of Artificial Sequence: Synthetic oligonucleotide
  Target: ATXN1; (-) strand; PAM type: NNGRRT; PAM sequence: AGGGGT
attggttactttcagttgcc

SEQ ID NO: 17431 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tctccaaacgttgaaataaa

SEQ ID NO: 17432 - DNA, 20 bp, Artificial Sequence
  Description of Artificial Sequence: Synthetic oligonucleotide
  Target: ATXN1; (-) strand; PAM type: NNGRRT; PAM sequence: GCGGGT
tcatacggcagtatttgatt

SEQ ID NO: 17433 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gaaagggagaagattcccta

SEQ ID NO: 17434 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaaagtgc

SEQ ID NO: 17435 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattctcctgcctcagcctc

SEQ ID NO: 17436 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactccgtcacccaggc

SEQ ID NO: 17437 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tatttatttattttttgaga

SEQ ID NO: 17438 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tcattcataatgcagcattt

SEQ ID NO: 17439 - DNA, 20 bp, Artificial Sequence
  Description of Artificial Sequence: Synthetic oligonucleotide
  Target: ATXN1; (-) strand; PAM type: NNGRRT; PAM sequence: TTGGGT
atgagcattagtagccttat

SEQ ID NO: 17440 - DNA, 20 bp, Artificial Sequence
  Description of Artificial Sequence: Synthetic oligonucleotide
  Target: ATXN1; (-) strand; PAM type: NNGRRT; PAM sequence: TCGAAT
ttgtatatatatttttttca

SEQ ID NO: 17441 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aaaagggtgaatgtaagtta

SEQ ID NO: 17442 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ttgactagccatgtaaaagg

SEQ ID NO: 17443 - DNA, 20 bp, Artificial Sequence
  Description of Artificial Sequence: Synthetic oligonucleotide
  Target: ATXN1; (-) strand; PAM type: NNGRRT; PAM sequence: AAGGGT
cttcttgactagccatgtaa

SEQ ID NO: 17444 - DNA, 20 bp, Artificial Sequence
  Description of Artificial Sequence: Synthetic oligonucleotide
  Target: ATXN1; (-) strand; PAM type: NNGRRT; PAM sequence: CTGAGT
atctggcagggtcttaaaac

SEQ ID NO: 17445 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttagaggttattaaatctgg

SEQ ID NO: 17446 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gttttcataggctgttaatt

SEQ ID NO: 17447 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aaactagtgctaataccaga

SEQ ID NO: 17448 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tcaatgtccctaacatttaa

SEQ ID NO: 17449 - DNA, 20 bp, Artificial Sequence
  Description of Artificial Sequence: Synthetic oligonucleotide
  Target: ATXN1; (-) strand; PAM type: NNGRRT; PAM sequence: GAGAGT
attttccccacaactagatg

SEQ ID NO: 17450 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tatattctttttataggaag

SEQ ID NO: 17451 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttaatttgtgagttgggaat

SEQ ID NO: 17452 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gaaactttaatttgtgagtt

SEQ ID NO: 17453 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cataaccgaaactttaattt

SEQ ID NO: 17454 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ggaagatgtttccaaccaga

SEQ ID NO: 17455 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tcttggccagttgaacattc

SEQ ID NO: 17456 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tgatatccccaatcttgtga

SEQ ID NO: 17457 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aaaggctacaaaatacagca

SEQ ID NO: 17458 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agctgggagctctctgccag

SEQ ID NO: 17459 - DNA, 20 bp, Artificial Sequence
  Description of Artificial Sequence: Synthetic oligonucleotide
  Target: ATXN1; (-) strand; PAM type: NNGRRT; PAM sequence: GGGAAT
atagcactgattctggggag

SEQ ID NO: 17460 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tccctgtcctcttacctacg

SEQ ID NO: 17461 - DNA, 20 bp, Artificial Sequence
  Description of Artificial Sequence: Synthetic oligonucleotide
  Target: ATXN1; (-) strand; PAM type: NNGRRT; PAM sequence: GTGAAT
atgtgtcagctttttctggt

SEQ ID NO: 17462 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gaacatttagctgcttaaaa

SEQ ID NO: 17463 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aaaattgtaaacaattatat

SEQ ID NO: 17464 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgatagttgacagaaacaga

SEQ ID NO: 17465 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ggtatgatagttgacagaaa

SEQ ID NO: 17466 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tgcactgtaaatatagaaaa

SEQ ID NO: 17467 - DNA, 20 bp, Artificial Sequence
  Description of Artificial Sequence: Synthetic oligonucleotide
  Target: ATXN1; (-) strand; PAM type: NNGRRT; PAM sequence: TCGAGT
ttgcaagaaaaaaatctcat

SEQ ID NO: 17468 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gatagctctgaggttattgc

SEQ ID NO: 17469 - DNA, 20 bp, Artificial Sequence
  Description of Artificial Sequence: Synthetic oligonucleotide
  Target: ATXN1; (-) strand; PAM type: NNGRRT; PAM sequence: AAGAGT
catttgtatttctgccatag

SEQ ID NO: 17470 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtacattttctcaaaatcaa

SEQ ID NO: 17471 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tgaatagttggctgagactt

SEQ ID NO: 17472 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tacctaaatcgctgaaaata

SEQ ID NO: 17473 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tactatgtggcattgttagt

SEQ ID NO: 17474 - DNA, 20 bp, Artificial Sequence
  Description of Artificial Sequence: Synthetic oligonucleotide
  Target: ATXN1; (-) strand; PAM type: NNGRRT; PAM sequence: TAGAAT
agccatcttctaatataaga

SEQ ID NO: 17475 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gctgaatattccaatctctt

SEQ ID NO: 17476 - DNA, 20 bp, Artificial Sequence
  Description of Artificial Sequence: Synthetic oligonucleotide
  Target: ATXN1; (-) strand; PAM type: NNGRRT; PAM sequence: CTGAAT
atcagaaaattattagtatg

SEQ ID NO: 17477 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgc

SEQ ID NO: 17478 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tttgtatgtttttgtagaga

SEQ ID NO: 17479 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaagtagc

SEQ ID NO: 17480 - DNA, 20 bp, Artificial Sequence
  Description of Artificial Sequence: Synthetic oligonucleotide
  Target: ATXN1; (-) strand; PAM type: NNGRRT; PAM sequence: TCGAGT
cttaccgcaacctctgtctc

SEQ ID NO: 17481 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttcactcttgttgcccaggc

SEQ ID NO: 17482 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttctttttttttttttgaga

SEQ ID NO: 17483 - DNA, 20 bp, Artificial Sequence
  Description of Artificial Sequence: Synthetic oligonucleotide
  Target: ATXN1; (-) strand; PAM type: NNGRRT; PAM sequence: AAGGAT
agtgtcttgtgggaaagcca

SEQ ID NO: 17484 - DNA, 20 bp, Artificial Sequence
  Description of Artificial Sequence: Synthetic oligonucleotide
  Target: ATXN1; (-) strand; PAM type: NNGRRT; PAM sequence: TGGAGT
agtatacataaaatcctgtg

SEQ ID NO: 17485 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tgtacatgaaaagtgcagta

SEQ ID NO: 17486 - DNA, 20 bp, Artificial Sequence
  Description of Artificial Sequence: Synthetic oligonucleotide
  Target: ATXN1; (-) strand; PAM type: NNGRRT; PAM sequence: TTGAGT
cttttacatgtgttcttcca

SEQ ID NO: 17487 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aattttaaaagaggaatggt

SEQ ID NO: 17488 - DNA, 20 bp, Artificial Sequence
  Description of Artificial Sequence: Synthetic oligonucleotide
  Target: ATXN1; (-) strand; PAM type: NNGRRT; PAM sequence: AGGAAT
acaatacttaattttaaaag

SEQ ID NO: 17489 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aaagaagcttactattacaa

SEQ ID NO: 17490 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tgtattgaatatgggagact

SEQ ID NO: 17491 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gatagaatttattatctgta

SEQ ID NO: 17492 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttgaactttacacattctga

SEQ ID NO: 17493 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgctcccaccagaaaaaaac

SEQ ID NO: 17494 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttacagtgtcccaaagatgc

SEQ ID NO: 17495 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ggaacagaaggacatgtttg

SEQ ID NO: 17496 - DNA, 20 bp, Artificial Sequence
  Description of Artificial Sequence: Synthetic oligonucleotide
  Target: ATXN1; (-) strand; PAM type: NNGRRT; PAM sequence: GAGAAT
agctgaaaagtataatggat

SEQ ID NO: 17497 - DNA, 20 bp, Artificial Sequence
  Description of Artificial Sequence: Synthetic oligonucleotide
  Target: ATXN1; (-) strand; PAM type: NNGRRT; PAM sequence: ATGGAT
aaaagaagctgaaaagtata

SEQ ID NO: 17498 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cagtttgttaatcctcccgg

SEQ ID NO: 17499 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttcttcccttgaagggtctg

SEQ ID NO: 17500 - DNA, 20 bp, Artificial Sequence
  Description of Artificial Sequence: Synthetic oligonucleotide
  Target: ATXN1; (-) strand; PAM type: NNGRRT; PAM sequence: AAGGGT
cctgggtccttcttcccttg

SEQ ID NO: 17501 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gccccagtgtcagagctgcc

SEQ ID NO: 17502 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aacctgccccttgctctctc

SEQ ID NO: 17503 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cagcttttttctggttgttt

SEQ ID NO: 17504 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agtcctaaagagggggaaga

SEQ ID NO: 17505 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tattatgctttctaaaataa

SEQ ID NO: 17506 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ctcaaagaaataatgaaggg

SEQ ID NO: 17507 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ccattctcaaagaaataatg

SEQ ID NO: 17508 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tcatcatgtctcccttcctt

SEQ ID NO: 17509 - DNA, 20 bp, Artificial Sequence
  Description of Artificial Sequence: Synthetic oligonucleotide
  Target: ATXN1; (-) strand; PAM type: NNGRRT; PAM sequence: TGGGGT
agccattaaatagaagatcc

SEQ ID NO: 17510 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tcttccaagaggaacagaga

SEQ ID NO: 17511 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tgtgctctggtttcttggga

SEQ ID NO: 17512 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggtcctgtgctctggtttct

SEQ ID NO: 17513 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ctttttcatatgcatgaggc

SEQ ID NO: 17514 - DNA, 20 bp, Artificial Sequence
  Description of Artificial Sequence: Synthetic oligonucleotide
  Target: ATXN1; (-) strand; PAM type: NNGRRT; PAM sequence: GCGGAT
tgcattattgctcattgatg

SEQ ID NO: 17515 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ccagacaagggtgagctaat

SEQ ID NO: 17516 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ctgagctctttcatccagac

SEQ ID NO: 17517 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gctaaccaagctaactgaga

SEQ ID NO: 17518 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tccttatgttggacccaaca

SEQ ID NO: 17519 - DNA, 20 bp, Artificial Sequence
  Description of Artificial Sequence: Synthetic oligonucleotide
  Target: ATXN1; (-) strand; PAM type: NNGRRT; PAM sequence: GGGAAT
agggggtgatgctgaggcct

SEQ ID NO: 17520 - DNA, 20 bp, Artificial Sequence
  Description of Artificial Sequence: Synthetic oligonucleotide
  Target: ATXN1; (-) strand; PAM type: NNGRRT; PAM sequence: GGGGGT
attatccaagtgcttgggta

SEQ ID NO: 17521 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctactgaattatccaagtgc

SEQ ID NO: 17522 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gttctccccagtggcctcta

SEQ ID NO: 17523 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagcctgggtga

SEQ ID NO: 17524 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttgcatcactgcactccagc

SEQ ID NO: 17525 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggaggctgaggcac

SEQ ID NO: 17526 - DNA, 20 bp, Artificial Sequence
  Description of Artificial Sequence: Synthetic oligonucleotide
  Target: ATXN1; (-) strand; PAM type: NNGRRT; PAM sequence: CTGGGT
actaaaaatacaaaaattag

SEQ ID NO: 17527 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cggacagatcacctgaggtc

SEQ ID NO: 17528 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tattagtgttctttaggact

SEQ ID NO: 17529 - DNA, 20 bp, Artificial Sequence
  Description of Artificial Sequence: Synthetic oligonucleotide
  Target: ATXN1; (-) strand; PAM type: NNGRRT; PAM sequence: AAGGGT
caatgtatgtgaatgtgact

SEQ ID NO: 17530 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gcttatcatgggcaatgtat

SEQ ID NO: 17531 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tgtacagtaaatgtggagac

SEQ ID NO: 17532 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ggattaacagactggagagt

SEQ ID NO: 17533 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aagtgaggattaacagactg

SEQ ID NO: 17534 - DNA, 20 bp, Artificial Sequence
  Description of Artificial Sequence: Synthetic oligonucleotide
  Target: ATXN1; (-) strand; PAM type: NNGRRT; PAM sequence: GAGGAT
atgaatagaagcgggaaagt

SEQ ID NO: 17535 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aataaatacatataaagcat

SEQ ID NO: 17536 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtgattgattgtattacaaa

SEQ ID NO: 17537 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tctggcttatggatattaag

SEQ ID NO: 17538 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ctaatgaacatctctggctt

SEQ ID NO: 17539 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aggtcttcagctgtctgatg

SEQ ID NO: 17540 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aatcccttcaatgtgatctc

SEQ ID NO: 17541 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cttgtcctaagcctgaatcc

SEQ ID NO: 17542 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aaggtttgcttgtcctaagc

SEQ ID NO: 17543 - DNA, 20 bp, Artificial Sequence
  Description of Artificial Sequence: Synthetic oligonucleotide
  Target: ATXN1; (-) strand; PAM type: NNGRRT; PAM sequence: TGGAGT
caagcatgtttgtactagaa

SEQ ID NO: 17544 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gttgccaagcatgtttgtac

SEQ ID NO: 17545 - DNA, 20 bp, Artificial Sequence
  Description of Artificial Sequence: Synthetic oligonucleotide
  Target: ATXN1; (-) strand; PAM type: NNGRRT; PAM sequence: TGGAGT
agggaaagttgcagggatcc

SEQ ID NO: 17546 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gaggaagaagggaaagttgc

SEQ ID NO: 17547 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atatctcagggcaggggatg

SEQ ID NO: 17548 - DNA, 20 bp, Artificial Sequence
  Description of Artificial Sequence: Synthetic oligonucleotide
  Target: ATXN1; (-) strand; PAM type: NNGRRT; PAM sequence: GGGGAT
acagataatatctcagggca

SEQ ID NO: 17549 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gttggccccatggtctgcct

SEQ ID NO: 17550 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ccttcaagcgtgatcatggg

SEQ ID NO: 17551 - DNA, 20 bp, Artificial Sequence
  Description of Artificial Sequence: Synthetic oligonucleotide
  Target: ATXN1; (-) strand; PAM type: NNGRRT; PAM sequence: GGGGAT
acaatagtccctgaagtttg

SEQ ID NO: 17552 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tttaaaatgagaggagggtt

SEQ ID NO: 17553 - DNA, 20 bp, Artificial Sequence
  Description of Artificial Sequence: Synthetic oligonucleotide
  Target: ATXN1; (-) strand; PAM type: NNGRRT; PAM sequence: GAGGGT
agaaaactttaaaatgagag

SEQ ID NO: 17554 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaggaacttggtctcccata

SEQ ID NO: 17555 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aaggggtggggctgagacct

SEQ ID NO: 17556 - DNA, 20 bp, Artificial Sequence
  Description of Artificial Sequence: Synthetic oligonucleotide
  Target: ATXN1; (-) strand; PAM type: NNGRRT; PAM sequence: AGGGGT
attagccaagggtttgggta

SEQ ID NO: 17557 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctgtggaattagccaagggt

SEQ ID NO: 17558 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aggcctctgtggaattagcc

SEQ ID NO: 17559 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cagagtgagacaggcctctg

SEQ ID NO: 17560 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagcctgggcga

SEQ ID NO: 17561 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gccttaggaaaatgaggaag

SEQ ID NO: 17562 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctggttgagcacgctgggaa

SEQ ID NO: 17563 - DNA, 20 bp, Artificial Sequence
  Description of Artificial Sequence: Synthetic oligonucleotide
  Target: ATXN1; (-) strand; PAM type: NNGRRT; PAM sequence: GAGAGT
atacattatctctattagca

SEQ ID NO: 17564 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aattgaattatatattcatt

SEQ ID NO: 17565 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atataatacattcaaggaaa

SEQ ID NO: 17566 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aacatgaaggcgaattaatg

SEQ ID NO: 17567 - DNA, 20 bp, Artificial Sequence
  Description of Artificial Sequence: Synthetic oligonucleotide
  Target: ATXN1; (-) strand; PAM type: NNGRRT; PAM sequence: GCGAAT
atcactcttagaacatgaag

SEQ ID NO: 17568 - DNA, 20 bp, Artificial Sequence
  Description of Artificial Sequence: Synthetic oligonucleotide
  Target: ATXN1; (-) strand; PAM type: NNGRRT; PAM sequence: GAGGGT
atttctggagccagaagtgg

SEQ ID NO: 17569 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgacataacagtgaaagcat

SEQ ID NO: 17570 - DNA, 20 bp, Artificial Sequence
  Description of Artificial Sequence: Synthetic oligonucleotide
  Target: ATXN1; (-) strand; PAM type: NNGRRT; PAM sequence: TGGGAT
aatggcattagtgatcaaag

SEQ ID NO: 17571 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gggcggggaggtggtggcgt

SEQ ID NO: 17572 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tgctccacactccacttatt

SEQ ID NO: 17573 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tgtttttgtgtgcgtgtggt

SEQ ID NO: 17574 - DNA, 20 bp, Artificial Sequence
  Description of Artificial Sequence: Synthetic oligonucleotide
  Target: ATXN1; (-) strand; PAM type: NNGRRT; PAM sequence: GGGAGT
cttttcttcagattctagca

SEQ ID NO: 17575 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gctttatcaattaggctcaa

SEQ ID NO: 17576 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tagtttttacagtttaaaga

SEQ ID NO: 17577 - DNA, 20 bp, Artificial Sequence
  Description of Artificial Sequence: Synthetic oligonucleotide
  Target: ATXN1; (-) strand; PAM type: NNGRRT; PAM sequence: AAGAAT
attttagtttttacagttta

SEQ ID NO: 17578 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ataatttattgaacgataaa

SEQ ID NO: 17579 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaaaaacagaacttttcatt

SEQ ID NO: 17580 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tttttagaatttgcattttt

SEQ ID NO: 17581 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aatgcattttgagtaatttt

SEQ ID NO: 17582 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aagcgaaaagacaatgcatt

SEQ ID NO: 17583 - DNA, 20 bp, Artificial Sequence
  Description of Artificial Sequence: Synthetic oligonucleotide
  Target: ATXN1; (-) strand; PAM type: NNGRRT; PAM sequence: TGGGAT
actctgtgttatgtatgttt

SEQ ID NO: 17584 - DNA, 20 bp, Artificial Sequence
  Description of Artificial Sequence: Synthetic oligonucleotide
  Target: ATXN1; (-) strand; PAM type: NNGRRT; PAM sequence: AAGGAT
accttttaggaaagacctgg

SEQ ID NO: 17585 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gctgtctcgtggaatattgg

SEQ ID NO: 17586 - DNA, 20 bp, Artificial Sequence
  Description of Artificial Sequence: Synthetic oligonucleotide
  Target: ATXN1; (-) strand; PAM type: NNGRRT; PAM sequence: TTGGAT
cctggctgtctcgtggaata

SEQ ID NO: 17587 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cgggaagcctggctgtctcg

SEQ ID NO: 17588 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tcaaggtggaccactatgag

SEQ ID NO: 17589 - DNA, 20 bp, Artificial Sequence
  Description of Artificial Sequence: Synthetic oligonucleotide
  Target: ATXN1; (-) strand; PAM type: NNGRRT; PAM sequence: AAGAAT
actgagtagctcgagtggtc

SEQ ID NO: 17590 - DNA, 20 bp, Artificial Sequence
  Description of Artificial Sequence: Synthetic oligonucleotide
  Target: ATXN1; (-) strand; PAM type: NNGRRT; PAM sequence: TCGAGT
agagagaaatactgagtagc

SEQ ID NO: 17591 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttctagcctagagagaaata

SEQ ID NO: 17592 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tggaaaaattgacttcccat

SEQ ID NO: 17593 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtgtcattgtaaacactaga

SEQ ID NO: 17594 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcctgaattctctgagcata

SEQ ID NO: 17595 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttttagaagttgagttcatc

SEQ ID NO: 17596 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ggtgctttttattttagaag

SEQ ID NO: 17597 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tcttaatacattgtactttt

SEQ ID NO: 17598 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tctaaactttttctacaact

SEQ ID NO: 17599 - DNA, 20 bp, Artificial Sequence
  Description of Artificial Sequence: Synthetic oligonucleotide
  Target: ATXN1; (-) strand; PAM type: NNGRRT; PAM sequence: ATGAGT
atacagctttggtgacctct

SEQ ID NO: 17600 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tgccttatactttgtttggt

SEQ ID NO: 17601 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ctccgtgaactcagttttca

SEQ ID NO: 17602 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ccaggggttatgctggaacc

SEQ ID NO: 17603 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ttaatagtaagttctcaacc

SEQ ID NO: 17604 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gatacaatatacacaagtcc

SEQ ID NO: 17605 - DNA, 20 bp, Artificial Sequence
  Description of Artificial Sequence: Synthetic oligonucleotide
  Target: ATXN1; (-) strand; PAM type: NNGRRT; PAM sequence: TGGAGT
attctgtaccaccttgcctc

SEQ ID NO: 17606 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ctatggagaaagccaaagtt

SEQ ID NO: 17607 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aagcaggtacttcatcatta

SEQ ID NO: 17608 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ggctggctattttccaccaa

SEQ ID NO: 17609 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctttgcacaattaccctgtt

SEQ ID NO: 17610 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aaagcagattggatgtcacc

SEQ ID NO: 17611 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gtgagccgggtaaaagcaga

SEQ ID NO: 17612 - DNA, 20 bp, Artificial Sequence
  Description of Artificial Sequence: Synthetic oligonucleotide
  Target: ATXN1; (-) strand; PAM type: NNGRRT; PAM sequence: CCGGGT
cccaattgtaaataagtgag

SEQ ID NO: 17613 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aaatagtttattggtagttt

SEQ ID NO: 17614 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ttgtcagggatatcataaat

SEQ ID NO: 17615 - DNA, 20 bp, Artificial Sequence
  Description of Artificial Sequence: Synthetic oligonucleotide
  Target: ATXN1; (-) strand; PAM type: NNGRRT; PAM sequence: AGGGAT
atcaggttttggtggttgtc

SEQ ID NO: 17616 - DNA, 20 bp, Artificial Sequence
  Description of Artificial Sequence: Synthetic oligonucleotide
  Target: ATXN1; (-) strand; PAM type: NNGRRT; PAM sequence: CAGAGT
cacacacacatacacacaca

SEQ ID NO: 17617 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gactcaccagctccatccaa

SEQ ID NO: 17618 - DNA, 20 bp, Artificial Sequence
  Description of Artificial Sequence: Synthetic oligonucleotide
  Target: ATXN1; (-) strand; PAM type: NNGRRT; PAM sequence: ATGAGT
accccagacttgctttcctc

SEQ ID NO: 17619 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ctgcgctctagcctgagcaa

SEQ ID NO: 17620 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggaggatcccatgggccc

SEQ ID NO: 17621 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ctgctcgggagctgaggtgg

SEQ ID NO: 17622 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gaaaaaaaagaaaaaattga

SEQ ID NO: 17623 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggaggatcccttgagccc

SEQ ID NO: 17624 - DNA, 20 bp, Artificial Sequence
  Description of Artificial Sequence: Synthetic oligonucleotide
  Target: ATXN1; (-) strand; PAM type: NNGRRT; PAM sequence: GAGGAT
acaaatctaggccaaggtgg

SEQ ID NO: 17625 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ataaatgtcaagattgctaa

SEQ ID NO: 17626 - DNA, 20 bp, Artificial Sequence
  Description of Artificial Sequence: Synthetic oligonucleotide
  Target: ATXN1; (-) strand; PAM type: NNGRRT; PAM sequence: CAGGAT
agtttctgagacccattgta

SEQ ID NO: 17627 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgaggaatttgtcaaaaaaa

SEQ ID NO: 17628 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tccaaatgaagacaaaaatg

SEQ ID NO: 17629 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tgtcatcttcctctcttgta

SEQ ID NO: 17630 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ccagtgttcccttcagaatc

SEQ ID NO: 17631 - DNA, 20 bp, Artificial Sequence
  Description of Artificial Sequence: Synthetic oligonucleotide
  Target: ATXN1; (-) strand; PAM type: NNGRRT; PAM sequence: CAGAAT
acccaacccagtgttccctt

SEQ ID NO: 17632 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ccaaagggtcacttgagcag

SEQ ID NO: 17633 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tgctcatgcagtcccagcca

SEQ ID NO: 17634 - DNA, 20 bp, Artificial Sequence
  Description of Artificial Sequence: Synthetic oligonucleotide
  Target: ATXN1; (-) strand; PAM type: NNGRRT; PAM sequence: CTGGAT
agtattttaaaaaacctcaa

SEQ ID NO: 17635 - DNA, 20 bp, Artificial Sequence
  Description of Artificial Sequence: Synthetic oligonucleotide
  Target: ATXN1; (-) strand; PAM type: NNGRRT; PAM sequence: CTGAAT
agagtggagagctgaagatt

SEQ ID NO: 17636 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gaaggaaggcaggttgctga

SEQ ID NO: 17637 - DNA, 20 bp, Artificial Sequence
  Description of Artificial Sequence: Synthetic oligonucleotide
  Target: ATXN1; (-) strand; PAM type: NNGRRT; PAM sequence: AGGAAT
catctagttgccagtggagg

SEQ ID NO: 17638 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gagttaatccctctggtaat

SEQ ID NO: 17639 - DNA, 20 bp, Artificial Sequence
  Description of Artificial Sequence: Synthetic oligonucleotide
  Target: ATXN1; (-) strand; PAM type: NNGRRT; PAM sequence: TGGAGT
taaaaccttcaagagaactt

SEQ ID NO: 17640 - DNA, 20 bp, Artificial Sequence
  Description of Artificial Sequence: Synthetic oligonucleotide
  Target: ATXN1; (-) strand; PAM type: NNGRRT; PAM sequence: AAGAAT
caagaggttaattacctttg

SEQ ID NO: 17641 - DNA, 20 bp, Artificial Sequence
  Description of Artificial Sequence: Synthetic oligonucleotide
  Target: ATXN1; (-) strand; PAM type: NNGRRT; PAM sequence: TTGAGT
attcatatgttcctaaacac

SEQ ID NO: 17642 - DNA, 20 bp, Artificial Sequence
  Description of Artificial Sequence: Synthetic oligonucleotide
  Target: ATXN1; (-) strand; PAM type: NNGRRT; PAM sequence: TTGGGT
actgactacattggtgctgg

SEQ ID NO: 17643 - DNA, 20 bp, Artificial Sequence
  Description of Artificial Sequence: Synthetic oligonucleotide
  Target: ATXN1; (-) strand; PAM type: NNGRRT; PAM sequence: GGGGAT
gcatcatcgtgctttatgaa

SEQ ID NO: 17644 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tggcaccatctttttcactg

SEQ ID NO: 17645 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gatttgggacctgattccaa

SEQ ID NO: 17646 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ccatggatgccgtaggtgta

SEQ ID NO: 17647 - DNA, 20 bp, Artificial Sequence
  Description of Artificial Sequence: Synthetic oligonucleotide
  Target: ATXN1; (-) strand; PAM type: NNGRRT; PAM sequence: ATGGAT
aattttacttagcttgtccc

SEQ ID NO: 17648 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttttttcttatttatctgtt

SEQ ID NO: 17649 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ggggagttaggattcgacat

SEQ ID NO: 17650 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aatactatcacgtggggagt

SEQ ID NO: 17651 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ctccctaatactatcacgtg

SEQ ID NO: 17652 - DNA, 20 bp, Artificial Sequence
  Description of Artificial Sequence: Synthetic oligonucleotide
  Target: ATXN1; (-) strand; PAM type: NNGRRT; PAM sequence: GGGAGT
agaggcaaagcagttcctgg

SEQ ID NO: 17653 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgc

SEQ ID NO: 17654 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aattctactgtctcagcctc

SEQ ID NO: 17655 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcgctcagtcgcccaggc

SEQ ID NO: 17656 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tcatataaagtacatatttg

SEQ ID NO: 17657 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atggctgctaaggtagaggt

SEQ ID NO: 17658 - DNA, 20 bp, Artificial Sequence
  Description of Artificial Sequence: Synthetic oligonucleotide
  Target: ATXN1; (-) strand; PAM type: NNGRRT; PAM sequence: TTGAGT
attgggtataattgtctttc

SEQ ID NO: 17659 - DNA, 20 bp, Artificial Sequence
  Description of Artificial Sequence: Synthetic oligonucleotide
  Target: ATXN1; (-) strand; PAM type: NNGRRT; PAM sequence: TTGGGT
catatgaatgtgtgtgttaa

SEQ ID NO: 17660 - DNA, 20 bp, Artificial Sequence
  Description of Artificial Sequence: Synthetic oligonucleotide
  Target: ATXN1; (-) strand; PAM type: NNGRRT; PAM sequence: ATGAAT
taggtatttgtacccttcat

SEQ ID NO: 17661 - DNA, 20 bp, Artificial Sequence
  Description of Artificial Sequence: Synthetic oligonucleotide
  Target: ATXN1; (-) strand; PAM type: NNGRRT; PAM sequence: TGGAAT
atgtacctgtaagaacacaa

SEQ ID NO: 17662 - DNA, 20 bp, Artificial Sequence
  Description of Artificial Sequence: Synthetic oligonucleotide
  Target: ATXN1; (-) strand; PAM type: NNGRRT; PAM sequence: TGGAAT
taaagtgaaaatatagaaca

SEQ ID NO: 17663 - DNA, 20 bp, Artificial Sequence
  Description of Artificial Sequence: Synthetic oligonucleotide
  Target: ATXN1; (-) strand; PAM type: NNGRRT; PAM sequence: GTGAGT
agaagttagggcatgcacta

SEQ ID NO: 17664 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gtgctctttttagtatttca

SEQ ID NO: 17665 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aattctcaggcaggagagaa

SEQ ID NO: 17666 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tattaaattctcaggcagga

SEQ ID NO: 17667 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gagttctgtttgatcaagtc

SEQ ID NO: 17668 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gtgcagaaggaggtagttaa

SEQ ID NO: 17669 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gcatcaattatgttctcacg

SEQ ID NO: 17670 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctgaaggtacttcagagtct

SEQ ID NO: 17671 - DNA, 20 bp, Artificial Sequence
  Description of Artificial Sequence: Synthetic oligonucleotide
  Target: ATXN1; (-) strand; PAM type: NNGRRT; PAM sequence: CAGAGT
atctttccctgaaggtactt

SEQ ID NO: 17672 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gtcaccaattttcaaagaat

SEQ ID NO: 17673 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tcctaggtcaccaattttca

SEQ ID NO: 17674 - DNA, 20 bp, Artificial Sequence
  Description of Artificial Sequence: Synthetic oligonucleotide
  Target: ATXN1; (-) strand; PAM type: NNGRRT; PAM sequence: GGGGGT
taactctgtgaagggtgact

SEQ ID NO: 17675 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tttttacaattaactctgtg

SEQ ID NO: 17676 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aatcccagtttttcctaccc

SEQ ID NO: 17677 - DNA, 20 bp, Artificial Sequence
  Description of Artificial Sequence: Synthetic oligonucleotide
  Target: ATXN1; (-) strand; PAM type: NNGRRT; PAM sequence: CGGAAT
gacttttataattagtgtgt

SEQ ID NO: 17678 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gttattttttgttcaaacaa

SEQ ID NO: 17679 - DNA, 20 bp, Artificial Sequence
  Description of Artificial Sequence: Synthetic oligonucleotide
  Target: ATXN1; (-) strand; PAM type: NNGRRT; PAM sequence: TCGGAT
atatttttgagtactgataa

SEQ ID NO: 17680 - DNA, 20 bp, Artificial Sequence
  Description of Artificial Sequence: Synthetic oligonucleotide
  Target: ATXN1; (-) strand; PAM type: NNGRRT; PAM sequence: TTGAGT
actcctctgtttttatattt

SEQ ID NO: 17681 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tacttgggaggctgaggcag

SEQ ID NO: 17682 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ctccagagaggagatgtgag

SEQ ID NO: 17683 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gaattctccagagaggagat

SEQ ID NO: 17684 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ggtagtaggaccctcttatc

SEQ ID NO: 17685 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ggagggaagttaaccctagg

SEQ ID NO: 17686 - DNA, 20 bp, Artificial Sequence
  Description of Artificial Sequence: Synthetic oligonucleotide
  Target: ATXN1; (-) strand; PAM type: NNGRRT; PAM sequence: TAGAGT
atcacttactgaagtggtgg

SEQ ID NO: 17687 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gtcattacctaactgataaa

SEQ ID NO: 17688 - DNA, 20 bp, Artificial Sequence
  Description of Artificial Sequence: Synthetic oligonucleotide
  Target: ATXN1; (-) strand; PAM type: NNGRRT; PAM sequence: GTGAAT
acagaataacagtgacaatt

SEQ ID NO: 17689 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agaatggtcactgtggttca

SEQ ID NO: 17690 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtgggtggtaggtggttgtg

SEQ ID NO: 17691 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gcccaagagccaccacttca

SEQ ID NO: 17692 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tcataagactgcttaaaaga

SEQ ID NO: 17693 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tactgcaggaggaggagcta

SEQ ID NO: 17694 - DNA, 20 bp, Artificial Sequence
  Description of Artificial Sequence: Synthetic oligonucleotide
  Target: ATXN1; (-) strand; PAM type: NNGRRT; PAM sequence: CTGGAT
caggaaacagaggtagtcat

SEQ ID NO: 17695 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tggtgggcttgcttgggtac

SEQ ID NO: 17696 - DNA, 20 bp, Artificial Sequence
  Description of Artificial Sequence: Synthetic oligonucleotide
  Target: ATXN1; (-) strand; PAM type: NNGRRT; PAM sequence: TTGGGT
cacacacctggtgggcttgc

SEQ ID NO: 17697 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ctaggctgggcccagggctc

SEQ ID NO: 17698 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agtaactgcccaaatggaca

SEQ ID NO: 17699 - DNA, 20 bp, Artificial Sequence
  Description of Artificial Sequence: Synthetic oligonucleotide
  Target: ATXN1; (-) strand; PAM type: NNGRRT; PAM sequence: CAGGGT
taatttattttttgtaaaga

SEQ ID NO: 17700 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gatcctcccgcctcagcctg

SEQ ID NO: 17701 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tcactctgttgcccaggcca

SEQ ID NO: 17702 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tgtatatatagagagagaaa

SEQ ID NO: 17703 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gagagcccaggagagctgtc

SEQ ID NO: 17704 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gaggcattcatagccatgtt

SEQ ID NO: 17705 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aatctgataaaatcactaag

SEQ ID NO: 17706 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aagtagagtgctactatata

SEQ ID NO: 17707 - DNA, 20 bp, Artificial Sequence
  Description of Artificial Sequence: Synthetic oligonucleotide
  Target: ATXN1; (-) strand; PAM type: NNGRRT; PAM sequence: TAGAGT
aaatttcctcccttcctaag

SEQ ID NO: 17708 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttccagatagtatatttact

SEQ ID NO: 17709 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aatgcaaaaccgtaattctt

SEQ ID NO: 17710 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cataggttcctctctacaca

SEQ ID NO: 17711 - DNA, 20 bp, Artificial Sequence
  Description of Artificial Sequence: Synthetic oligonucleotide
  Target: ATXN1; (-) strand; PAM type: NNGRRT; PAM sequence: GAGGGT
cttttccactattctgaaaa

SEQ ID NO: 17712 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tcttttcctctcttagcttt

SEQ ID NO: 17713 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tagagaaagaagagtcgaga

SEQ ID NO: 17714 - DNA, 20 bp, Artificial Sequence
  Description of Artificial Sequence: Synthetic oligonucleotide
  Target: ATXN1; (-) strand; PAM type: NNGRRT; PAM sequence: AAGAGT
agcaagaatattagagaaag

SEQ ID NO: 17715 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aactaccatgtttatatagc

SEQ ID NO: 17716 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgtgacagtgtggtgtccca

SEQ ID NO: 17717 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aatatgctaataatatgcta

SEQ ID NO: 17718 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ggcaaaaacttacttgtaat

SEQ ID NO: 17719 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gtagagtcttagacaagtcc

SEQ ID NO: 17720 - DNA, 20 bp, Artificial Sequence
  Description of Artificial Sequence: Synthetic oligonucleotide
  Target: ATXN1; (-) strand; PAM type: NNGRRT; PAM sequence: TAGAGT
aagggaagagaaggcctgag

SEQ ID NO: 17721 - DNA, 20 bp, Artificial Sequence
  Description of Artificial Sequence: Synthetic oligonucleotide
  Target: ATXN1; (-) strand; PAM type: NNGRRT; PAM sequence: CTGAGT
atttgaagggaagagaaggc

SEQ ID NO: 17722 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ctaaatggcgtctccttaac

SEQ ID NO: 17723 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaaagagtgctgttaaaaag

SEQ ID NO: 17724 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gatttttgtaccaaaaaaaa

SEQ ID NO: 17725 - DNA, 20 bp, Artificial Sequence
  Description of Artificial Sequence: Synthetic oligonucleotide
  Target: ATXN1; (-) strand; PAM type: NNGRRT; PAM sequence: AAGGAT
agagagcactgggtgggaaa

SEQ ID NO: 17726 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ccttagctcttcagagagca

SEQ ID NO: 17727 - DNA, 20 bp, Artificial Sequence
  Description of Artificial Sequence: Synthetic oligonucleotide
  Target: ATXN1; (-) strand; PAM type: NNGRRT; PAM sequence: GCGGGT
atgaagagggtgggggaggg

SEQ ID NO: 17728 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gtttttatatgagacatgaa

SEQ ID NO: 17729 - DNA, 20 bp, Artificial Sequence
  Description of Artificial Sequence: Synthetic oligonucleotide
  Target: ATXN1; (-) strand; PAM type: NNGRRT; PAM sequence: GAGAGT
atttggggattaagcccagt

SEQ ID NO: 17730 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tgagtcaattaaaaacattt

SEQ ID NO: 17731 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gctagggagagcctcaccaa

SEQ ID NO: 17732 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tccatgtttggctttgttag

SEQ ID NO: 17733 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tagtcgatggggcagcttga

SEQ ID NO: 17734 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggggcaaagcttccgggtgc

SEQ ID NO: 17735 - DNA, 20 bp, Artificial Sequence
  Description of Artificial Sequence: Synthetic oligonucleotide
  Target: ATXN1; (-) strand; PAM type: NNGRRT; PAM sequence: CCGGGT
tgctctctggggcaaagctt

SEQ ID NO: 17736 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cctggcaataggaaagcact

SEQ ID NO: 17737 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gcgccattagaagggatgat

SEQ ID NO: 17738 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tctcttgctgcgccattaga

SEQ ID NO: 17739 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tacaggtgaaaagttaacca

SEQ ID NO: 17740 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aggtgctgtttaaatgaata

SEQ ID NO: 17741 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gttctttaggtgctgtttaa

SEQ ID NO: 17742 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tcagcaacagtcactaatga

SEQ ID NO: 17743 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gagtgagaatgggaggggca

SEQ ID NO: 17744 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atctcccagctactgggagt

SEQ ID NO: 17745 - DNA, 20 bp, Artificial Sequence
  Description of Artificial Sequence: Synthetic oligonucleotide
  Target: ATXN1; (-) strand; PAM type: NNGRRT; PAM sequence: GGGAGT
agcatcatctcccagctact

SEQ ID NO: 17746 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttgaattggacggacaatcg

SEQ ID NO: 17747 - DNA, 20 bp, Artificial Sequence
  Description of Artificial Sequence: Synthetic oligonucleotide
  Target: ATXN1; (-) strand; PAM type: NNGRRT; PAM sequence: TTGAAT
attaaatacagtttatttta

SEQ ID NO: 17748 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttttgaaatgcagtttaata

SEQ ID NO: 17749 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gagatttctaacaggttcag

SEQ ID NO: 17750 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gttactcaatttgtaaaaca

SEQ ID NO: 17751 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aacccacttggaatctagct

SEQ ID NO: 17752 - DNA, 20 bp, Artificial Sequence
  Description of Artificial Sequence: Synthetic oligonucleotide
  Target: ATXN1; (-) strand; PAM type: NNGRRT; PAM sequence: TGGAAT
agtcctccctgaaacccact

SEQ ID NO: 17753 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gatgagtcaaaggtaaagct

SEQ ID NO: 17754 - DNA, 20 bp, Artificial Sequence
  Description of Artificial Sequence: Synthetic oligonucleotide
  Target: ATXN1; (-) strand; PAM type: NNGRRT; PAM sequence: ATGAGT
agttttcagacctcactctg

SEQ ID NO: 17755 - DNA, 20 bp, Artificial Sequence
  Description of Artificial Sequence: Synthetic oligonucleotide
  Target: ATXN1; (-) strand; PAM type: NNGRRT; PAM sequence: GCGAGT
tgattcttactcagaatcat

SEQ ID NO: 17756 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ggacacagttgattcttact

SEQ ID NO: 17757 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cccacgattatcactgaatt

SEQ ID NO: 17758 - DNA, 20 bp, Artificial Sequence
  Description of Artificial Sequence: Synthetic oligonucleotide
  Target: ATXN1; (-) strand; PAM type: NNGRRT; PAM sequence: CTGAAT
agaatggcccacgattatca

SEQ ID NO: 17759 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gcaaaatctatttggtcaaa

SEQ ID NO: 17760 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgtttcatcctgagcggatt

SEQ ID NO: 17761 - DNA, 20 bp, Artificial Sequence
  Description of Artificial Sequence: Synthetic oligonucleotide
  Target: ATXN1; (-) strand; PAM type: NNGRRT; PAM sequence: GCGGAT
agtagtgtgtttcatcctga

SEQ ID NO: 17762 - DNA, 20 bp, Artificial Sequence
  Description of Artificial Sequence: Synthetic oligonucleotide
  Target: ATXN1; (-) strand; PAM type: NNGRRT; PAM sequence: GCGGAT
atagcttttcttttcattca

SEQ ID NO: 17763 - DNA, 20 bp, Artificial Sequence
  Description of Artificial Sequence: Synthetic oligonucleotide
  Target: ATXN1; (-) strand; PAM type: NNGRRT; PAM sequence: TGGAAT
taatagtttattttgtgact

SEQ ID NO: 17764 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tgaaaaggagagtgagaata

SEQ ID NO: 17765 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atgtcactgaaaaggagagt

SEQ ID NO: 17766 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ataaaaatgtcactgaaaag

SEQ ID NO: 17767 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tttaattgggaaagcattat

SEQ ID NO: 17768 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gggccggtcctggaagaccc

SEQ ID NO: 17769 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ccttgccaatactattcttc

SEQ ID NO: 17770 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gccgtaaggggtcggctggt

SEQ ID NO: 17771 - DNA, 20 bp, Artificial Sequence
  Description of Artificial Sequence: Synthetic oligonucleotide
  Target: ATXN1; (-) strand; PAM type: NNGRRT; PAM sequence: AGGGGT
agcgagtaggaatggccgta

SEQ ID NO: 17772 - DNA, 20 bp, Artificial Sequence
  Description of Artificial Sequence: Synthetic oligonucleotide
  Target: ATXN1; (-) strand; PAM type: NNGRRT; PAM sequence: AGGAAT
catgttgtcaggcagcgagt

SEQ ID NO: 17773 - DNA, 20 bp, Artificial Sequence
  Description of Artificial Sequence: Synthetic oligonucleotide
  Target: ATXN1; (-) strand; PAM type: NNGRRT; PAM sequence: GCGAGT
tttgatcatgttgtcaggca

SEQ ID NO: 17774 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tgtgctgctctgtaaatggc

SEQ ID NO: 17775 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctgaagctggggtatattgt

SEQ ID NO: 17776 - DNA, 20 bp, Artificial Sequence
  Description of Artificial Sequence: Synthetic oligonucleotide
  Target: ATXN1; (-) strand; PAM type: NNGRRT; PAM sequence: TGGGGT
aagccaaaggaggctgaagc

SEQ ID NO: 17777 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ctgcccacgtttggaggtct

SEQ ID NO: 17778 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gtgatagtaattgtcccatg

SEQ ID NO: 17779 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tgctggttcacggttcattc

SEQ ID NO: 17780 - DNA, 20 bp, Artificial Sequence
  Description of Artificial Sequence: Synthetic oligonucleotide
  Target: ATXN1; (-) strand; PAM type: NNGRRT; PAM sequence: TAGGGT
cacaacacgtatgccattcc

SEQ ID NO: 17781 - DNA, 20 bp, Artificial Sequence
  Description of Artificial Sequence: Synthetic oligonucleotide
  Target: ATXN1; (-) strand; PAM type: NNGRRT; PAM sequence: TAGGGT
attcattggtggtttatttt

SEQ ID NO: 17782 - DNA, 20 bp, Artificial Sequence
  Description of Artificial Sequence: Synthetic oligonucleotide
  Target: ATXN1; (-) strand; PAM type: NNGRRT; PAM sequence: AAGGGT
atgaagaagtgaatggccaa

SEQ ID NO: 17783 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ccccgtttatagatgaagaa

SEQ ID NO: 17784 - DNA, 20 bp, Artificial Sequence
  Description of Artificial Sequence: Synthetic oligonucleotide
  Target: ATXN1; (-) strand; PAM type: NNGRRT; PAM sequence: AGGAAT
catccctgtcttgtgtgtaa

SEQ ID NO: 17785 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cttccaacactatgttgaat

SEQ ID NO: 17786 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ccagaacttccaacactatg

SEQ ID NO: 17787 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttgacttcctcttttcctaa

SEQ ID NO: 17788 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggagatttgggctgagacaa

SEQ ID NO: 17789 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tttgtctgttagtggtgtat

SEQ ID NO: 17790 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ttattctctttgaagcagtt

SEQ ID NO: 17791 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttcttcacatcccttgtaag

SEQ ID NO: 17792 - DNA, 20 bp, Artificial Sequence
  Description of Artificial Sequence: Synthetic oligonucleotide
  Target: ATXN1; (-) strand; PAM type: NNGRRT; PAM sequence: AGGGGT
tggtttgtagttctccttga

SEQ ID NO: 17793 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cttcttcctttccatgagca

SEQ ID NO: 17794 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gtagcttgatggggatggca

SEQ ID NO: 17795 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aaagtcattggtagcttgat

SEQ ID NO: 17796 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ccagctttgttcttttggct

SEQ ID NO: 17797 - DNA, 20 bp, Artificial Sequence
  Description of Artificial Sequence: Synthetic oligonucleotide
  Target: ATXN1; (-) strand; PAM type: NNGRRT; PAM sequence: TCGGAT
tttgtcaggtttgtcaaaga

SEQ ID NO: 17798 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ccagcaccatttattaaata

SEQ ID NO: 17799 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ttttgtataaggtgtaagga

SEQ ID NO: 17800 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atttaagtctttaatccatc

SEQ ID NO: 17801 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gtattgcctaggttttcttc

SEQ ID NO: 17802 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tcgttgcccatgcctatgtc

SEQ ID NO: 17803 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ggatattagccctttgtccg

SEQ ID NO: 17804 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gtttgagttctttgtagatt

SEQ ID NO: 17805 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tttttttcttgtaaatttgt

SEQ ID NO: 17806 - DNA, 20 bp, Artificial Sequence
  Description of Artificial Sequence: Synthetic oligonucleotide
  Target: ATXN1; (-) strand; PAM type: NNGRRT; PAM sequence: TGGGGT
atccttcgcccactttttga

SEQ ID NO: 17807 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tttctagttctagatccctg

SEQ ID NO: 17808 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tatacccagtaatgggatgg

SEQ ID NO: 17809 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ttttggtatatacccagtaa

SEQ ID NO: 17810 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ggttccaagtctttgctatt

SEQ ID NO: 17811 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agtttatcattgttggacat

SEQ ID NO: 17812 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgtccttgcgatagtttgct

SEQ ID NO: 17813 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tcattgttcaattcccacct

SEQ ID NO: 17814 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ccccaccccacaacaggccc

SEQ ID NO: 17815 - DNA, 20 bp, Artificial Sequence
  Description of Artificial Sequence: Synthetic oligonucleotide
  Target: ATXN1; (-) strand; PAM type: NNGRRT; PAM sequence: TAGGGT
taaaattatactttaagttt

SEQ ID NO: 17816 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agagaaatatagagttataa

SEQ ID NO: 17817 - DNA, 20 bp, Artificial Sequence
  Description of Artificial Sequence: Synthetic oligonucleotide
  Target: ATXN1; (-) strand; PAM type: NNGRRT; PAM sequence: TAGAGT
agaggttataaagagaaata

SEQ ID NO: 17818 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tataggcacagtttcctaaa

SEQ ID NO: 17819 - DNA, 20 bp, Artificial Sequence
  Description of Artificial Sequence: Synthetic oligonucleotide
  Target: ATXN1; (-) strand; PAM type: NNGRRT; PAM sequence: CGGGAT
gcctcggcctcccaaagtgc

SEQ ID NO: 17820 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttgtatttttagtagaga

SEQ ID NO: 17821 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggctcaggctcccgggtagc

SEQ ID NO: 17822 - DNA, 20 bp, Artificial Sequence
  Description of Artificial Sequence: Synthetic oligonucleotide
  Target: ATXN1; (-) strand; PAM type: NNGRRT; PAM sequence: CCGGGT
aattctcctggctcaggctc

SEQ ID NO: 17823 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctcgctcttgttgcctgcac

SEQ ID NO: 17824 - DNA, 20 bp, Artificial Sequence
  Description of Artificial Sequence: Synthetic oligonucleotide
  Target: ATXN1; (-) strand; PAM type: NNGRRT; PAM sequence: TGGAAT
attgctttgtttttttgaga

SEQ ID NO: 17825 - DNA, 20 bp, Artificial Sequence
  Description of Artificial Sequence: Synthetic oligonucleotide
  Target: ATXN1; (-) strand; PAM type: NNGRRT; PAM sequence: CCGAGT
ataagccattgctcttgcac

SEQ ID NO: 17826 - DNA, 20 bp, Artificial Sequence
  Description of Artificial Sequence: Synthetic oligonucleotide
  Target: ATXN1; (-) strand; PAM type: NNGRRT; PAM sequence: GGGGGT
cagtcaatcttggggggaaa

SEQ ID NO: 17827 - DNA, 20 bp, Artificial Sequence
  Description of Artificial Sequence: Synthetic oligonucleotide
  Target: ATXN1; (-) strand; PAM type: NNGRRT; PAM sequence: CGGAGT
aaagtgcagaaattaccgac

SEQ ID NO: 17828 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gaattgtttcaccccgggtg

SEQ ID NO: 17829 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ccgtaaggaattgtttcacc

SEQ ID NO: 17830 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ctctccaaaggctccccgta

SEQ ID NO: 17831 - DNA, 20 bp, Artificial Sequence
  Description of Artificial Sequence: Synthetic oligonucleotide
  Target: ATXN1; (-) strand; PAM type: NNGRRT; PAM sequence: TGGGGT
attccagcagcccccttgtt

SEQ ID NO: 17832 - DNA, 20 bp, Artificial Sequence
  Description of Artificial Sequence: Synthetic oligonucleotide
  Target: ATXN1; (-) strand; PAM type: NNGRRT; PAM sequence: CTGAGT
actgtgccccctccccctcg

SEQ ID NO: 17833 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gggtagggattttaggatca

SEQ ID NO: 17834 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gctccagcgggtagggattt

SEQ ID NO: 17835 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tctaggatgctccagcgggt

SEQ ID NO: 17836 - DNA, 20 bp, Artificial Sequence
  Description of Artificial Sequence: Synthetic oligonucleotide
  Target: ATXN1; (-) strand; PAM type: NNGRRT; PAM sequence: GCGGGT
agagactctaggatgctcca

SEQ ID NO: 17837 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tattcctgtcacagagactc

SEQ ID NO: 17838 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tcccagcataggctcactac

SEQ ID NO: 17839 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gctattgtttgaagtaggtc

SEQ ID NO: 17840 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tctttccctaaaacctagtg

SEQ ID NO: 17841 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tcagtttgggtctgtgactg

SEQ ID NO: 17842 - DNA, 20 bp, Artificial Sequence
  Description of Artificial Sequence: Synthetic oligonucleotide
  Target: ATXN1; (-) strand; PAM type: NNGRRT; PAM sequence: TTGGGT
attctgctccatcattcagt

SEQ ID NO: 17843 - DNA, 20 bp, Artificial Sequence
  Description of Artificial Sequence: Synthetic oligonucleotide
  Target: ATXN1; (-) strand; PAM type: NNGRRT; PAM sequence: GTGGAT
cagggaaagaattggactat

SEQ ID NO: 17844 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtgacttactggatcaggga

SEQ ID NO: 17845 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ggaacggcctccgtgactta

SEQ ID NO: 17846 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ctgcacttgtataaataggt

SEQ ID NO: 17847 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttggggaaccaagagaataa

SEQ ID NO: 17848 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cactgtgattggggaaccaa

SEQ ID NO: 17849 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gtagtgtctggtttgaggaa

SEQ ID NO: 17850 - DNA, 20 bp, Artificial Sequence
  Description of Artificial Sequence: Synthetic oligonucleotide
  Target: ATXN1; (-) strand; PAM type: NNGRRT; PAM sequence: GGGGGT
atattggaagtgaatgagag

SEQ ID NO: 17851 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tgagcaattagatattggaa

SEQ ID NO: 17852 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ttggagagatgttaataagc

SEQ ID NO: 17853 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aatggaagtgacagaatgga

SEQ ID NO: 17854 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tggagtggcaatggaagtga

SEQ ID NO: 17855 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ccccttgttctcatggagtt

SEQ ID NO: 17856 - DNA, 20 bp, Artificial Sequence
  Description of Artificial Sequence: Synthetic oligonucleotide
  Target: ATXN1; (-) strand; PAM type: NNGRRT; PAM sequence: TGGAGT
agacaggccccttgttctca

SEQ ID NO: 17857 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tgtagaaatccaggtgacag

SEQ ID NO: 17858 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tagacccattcaaggactgt

SEQ ID NO: 17859 - DNA, 20 bp, Artificial Sequence
  Description of Artificial Sequence: Synthetic oligonucleotide
  Target: ATXN1; (-) strand; PAM type: NNGRRT; PAM sequence: TTGGAT
cagagatcttggattttatc

SEQ ID NO: 17860 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttgtgagccaagcagagatc

SEQ ID NO: 17861 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ctgacaccgctagaggggct

SEQ ID NO: 17862 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gaagtgcaaaatagtattat

SEQ ID NO: 17863 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agtccaagcttttcagaatg

SEQ ID NO: 17864 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtccttcagtccaagctttt

SEQ ID NO: 17865 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gagtcaggttgactggagga

SEQ ID NO: 17866 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tggtagggtatgtttcatac

SEQ ID NO: 17867 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ctctctgttaagcattatgg

SEQ ID NO: 17868 - DNA, 20 bp, Artificial Sequence
  Description of Artificial Sequence: Synthetic oligonucleotide
  Target: ATXN1; (-) strand; PAM type: NNGRRT; PAM sequence: TAGGAT
attgaggctaaagcataaga

SEQ ID NO: 17869 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgc

SEQ ID NO: 17870 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cagggtttcaccttgttggt

SEQ ID NO: 17871 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtgtttttagtagaga

SEQ ID NO: 17872 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gcctcagtctcctgagtagc

SEQ ID NO: 17873 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aattctcctgcctcagtctc

SEQ ID NO: 17874 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gctccctgcaacttccgcct

SEQ ID NO: 17875 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttttttttttttttttgaga

SEQ ID NO: 17876 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aataaagcacttaaccctct

SEQ ID NO: 17877 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ccagtctggtttatttagcc

SEQ ID NO: 17878 - DNA, 20 bp, Artificial Sequence
  Description of Artificial Sequence: Synthetic oligonucleotide
  Target: ATXN1; (-) strand; PAM type: NNGRRT; PAM sequence: CTGAAT
atcagagaaagttaggaggc

SEQ ID NO: 17879 - DNA, 20 bp, Artificial Sequence
  Description of Artificial Sequence: Synthetic oligonucleotide
  Target: ATXN1; (-) strand; PAM type: NNGRRT; PAM sequence: GAGGAT
atgggatggattggaagaag

SEQ ID NO: 17880 - DNA, 20 bp, Artificial Sequence
  Description of Artificial Sequence: Synthetic oligonucleotide
  Target: ATXN1; (-) strand; PAM type: NNGRRT; PAM sequence: ATGGAT
atttgaaaagcatttatggg

SEQ ID NO: 17881 - DNA, 20 bp, Artificial Sequence
  Description of Artificial Sequence: Synthetic oligonucleotide
  Target: ATXN1; (-) strand; PAM type: NNGRRT; PAM sequence: TGGGAT
agaaatttgaaaagcattta

SEQ ID NO: 17882 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gaaaattgtatatctaagtc

SEQ ID NO: 17883 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttatttcatttcttcatctt

SEQ ID NO: 17884 - DNA, 20 bp, Artificial Sequence
  Description of Artificial Sequence: Synthetic oligonucleotide
  Target: ATXN1; (-) strand; PAM type: NNGRRT; PAM sequence: CAGGGT
caacttctttttcttggtgg

SEQ ID NO: 17885 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ctgtctcaagtgctgactgt

SEQ ID NO: 17886 - DNA, 20 bp, Artificial Sequence
  Description of Artificial Sequence: Synthetic oligonucleotide
  Target: ATXN1; (-) strand; PAM type: NNGRRT; PAM sequence: ATGAGT
agaagttgatggtgccaagt

SEQ ID NO: 17887 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aggatttggtgttgtatttg

SEQ ID NO: 17888 - DNA, 20 bp, Artificial Sequence
  Description of Artificial Sequence: Synthetic oligonucleotide
  Target: ATXN1; (-) strand; PAM type: NNGRRT; PAM sequence: GAGGAT
aggactggtggaacaaccgg

SEQ ID NO: 17889 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ccaggttagagtagtggcag

SEQ ID NO: 17890 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gactttaggagggtccaggt

SEQ ID NO: 17891 - DNA, 20 bp, Artificial Sequence
  Description of Artificial Sequence: Synthetic oligonucleotide
  Target: ATXN1; (-) strand; PAM type: NNGRRT; PAM sequence: GAGGGT
agaagtccaggagactttag

SEQ ID NO: 17892 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gagtagaagatagaattcat

SEQ ID NO: 17893 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tctctgggcagagtagaaga

SEQ ID NO: 17894 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tagaaagttcattctctggg

SEQ ID NO: 17895 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttaaccaccttctttcctgc

SEQ ID NO: 17896 - DNA, 20 bp, Artificial Sequence
  Description of Artificial Sequence: Synthetic oligonucleotide
  Target: ATXN1; (-) strand; PAM type: NNGRRT; PAM sequence: TCGGAT
gctttcttcctttggataga

SEQ ID NO: 17897 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttttgttttgctttcttcct

SEQ ID NO: 17898 - DNA, 20 bp, Artificial Sequence
  Description of Artificial Sequence: Synthetic oligonucleotide
  Target: ATXN1; (-) strand; PAM type: NNGRRT; PAM sequence: CAGAGT
attccattttgtctgatatt

SEQ ID NO: 17899 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ggttgttccttttgccagcc

SEQ ID NO: 17900 - DNA, 20 bp, Artificial Sequence
  Description of Artificial Sequence: Synthetic oligonucleotide
  Target: ATXN1; (-) strand; PAM type: NNGRRT; PAM sequence: GGGAAT
cattttaattcacagacgtg

SEQ ID NO: 17901 - DNA, 20 bp, Artificial Sequence
  Description of Artificial Sequence: Synthetic oligonucleotide
  Target: ATXN1; (-) strand; PAM type: NNGRRT; PAM sequence: GGGAAT
atttccattttatttcctct

SEQ ID NO: 17902 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttgtctagaaatctactgat

SEQ ID NO: 17903 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gccttggcctcccaaagtgc

SEQ ID NO: 17904 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtatttttagtagaga

SEQ ID NO: 17905 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaagtagc

SEQ ID NO: 17906 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaaactctgttcc

SEQ ID NO: 17907 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttcgctctttcacccaggc

SEQ ID NO: 17908 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttctttttttttttttgaga

SEQ ID NO: 17909 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tttccttctttttccctact

SEQ ID NO: 17910 - DNA, 20 bp, Artificial Sequence
  Description of Artificial Sequence: Synthetic oligonucleotide
  Target: ATXN1; (-) strand; PAM type: NNGRRT; PAM sequence: AAGAAT
taattttattaagctcttca

SEQ ID NO: 17911 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tcttatctatttagtgtctg

SEQ ID NO: 17912 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttgtgccaaggattttgata

SEQ ID NO: 17913 - DNA, 20 bp, Artificial Sequence
  Description of Artificial Sequence: Synthetic oligonucleotide
  Target: ATXN1; (-) strand; PAM type: NNGRRT; PAM sequence: AAGGAT
agttgtatcatcattgtgcc

SEQ ID NO: 17914 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tgcataactaccaccacaat

SEQ ID NO: 17915 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tctatgcattttaacatgtg

SEQ ID NO: 17916 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cacagtgaaatctttgggct

SEQ ID NO: 17917 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgttttttactattttctga

SEQ ID NO: 17918 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gattatataaaatgtattcg

SEQ ID NO: 17919 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tttctttatataatatttac

SEQ ID NO: 17920 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tgtgttattttgacctattg

SEQ ID NO: 17921 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ttaaaccaaacttgagttcc

SEQ ID NO: 17922 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttttaagtgttaaaccaaac

SEQ ID NO: 17923 - DNA, 20 bp, Artificial Sequence
  Description of Artificial Sequence: Synthetic oligonucleotide
  Target: ATXN1; (-) strand; PAM type: NNGRRT; PAM sequence: GTGAAT
atggttttccgctttatgtg

SEQ ID NO: 17924 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gtttttatcgggaatgtgtg

SEQ ID NO: 17925 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tgtgtttgtttgtttttatc

SEQ ID NO: 17926 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ccttctattctcttttttct

SEQ ID NO: 17927 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ggtttttcatttgcctttta

SEQ ID NO: 17928 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ctttttaatgaatttctgcc

SEQ ID NO: 17929 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tatctttctctgccttttta

SEQ ID NO: 17930 - DNA, 20 bp, Artificial Sequence
  Description of Artificial Sequence: Synthetic oligonucleotide
  Target: ATXN1; (-) strand; PAM type: NNGRRT; PAM sequence: CTGAAT
agaagttagttcagattgca

SEQ ID NO: 17931 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tggtggtgttctatctcctt

SEQ ID NO: 17932 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aaatcttgaaaacagatagc

SEQ ID NO: 17933 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aacaataaaattcaaaaata

SEQ ID NO: 17934 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcatgccactgcactccggc

SEQ ID NO: 17935 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tactggtgaggctgaggtgg

SEQ ID NO: 17936 - DNA, 20 bp, Artificial Sequence
  Description of Artificial Sequence: Synthetic oligonucleotide
  Target: ATXN1; (-) strand; PAM type: NNGRRT; PAM sequence: CTGGGT
actaaaaatacaaaaatcag

SEQ ID NO: 17937 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cagaaagattgcttgagctc

SEQ ID NO: 17938 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttaaaaataataataatagg

SEQ ID NO: 17939 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttgcattccatcctgggcag

SEQ ID NO: 17940 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggaggatcgcttgggccc

SEQ ID NO: 17941 - DNA, 20 bp, Artificial Sequence
  Description of Artificial Sequence: Synthetic oligonucleotide
  Target: ATXN1; (-) strand; PAM type: NNGRRT; PAM sequence: GAGGAT
accttgggaggctgaggtgg

SEQ ID NO: 17942 - DNA, 20 bp, Artificial Sequence
  Description of Artificial Sequence: Synthetic oligonucleotide
  Target: ATXN1; (-) strand; PAM type: NNGRRT; PAM sequence: AGGGGT
caaattaagatatgaggtgt

SEQ ID NO: 17943 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttaagtcatttatcagaaat

SEQ ID NO: 17944 - DNA, 20 bp, Artificial Sequence
  Description of Artificial Sequence: Synthetic oligonucleotide
  Target: ATXN1; (-) strand; PAM type: NNGRRT; PAM sequence: CTGGAT
atatgagttctttatatagt

SEQ ID NO: 17945 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gtatatatatgtgtatatat

SEQ ID NO: 17946 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgcacttccagcctgggcaa

SEQ ID NO: 17947 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgggaggggtcaagcctgca

SEQ ID NO: 17948 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gaggatcacttgagcctggg

SEQ ID NO: 17949 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tactcaggaggctgaggtgg

SEQ ID NO: 17950 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ggccaaggcaggcatattgc

SEQ ID NO: 17951 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gttcttgagcttcatacaaa

SEQ ID NO: 17952 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tttgatttctgtcactgtaa

SEQ ID NO: 17953 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gtacagcgcaatgagttttg

SEQ ID NO: 17954 - DNA, 20 bp, Artificial Sequence
  Description of Artificial Sequence: Synthetic oligonucleotide
  Target: ATXN1; (-) strand; PAM type: NNGRRT; PAM sequence: ATGAGT
catcttaagcgtacagcgca

SEQ ID NO: 17955 - DNA, 20 bp, Artificial Sequence
  Description of Artificial Sequence: Synthetic oligonucleotide
  Target: ATXN1; (-) strand; PAM type: NNGRRT; PAM sequence: AGGGGT
actgttcctttgtacggaat

SEQ ID NO: 17956 - DNA, 20 bp, Artificial Sequence
  Description of Artificial Sequence: Synthetic oligonucleotide
  Target: ATXN1; (-) strand; PAM type: NNGRRT; PAM sequence: CGGAAT
atgttcactgttcctttgta

SEQ ID NO: 17957 - DNA, 20 bp, Artificial Sequence
  Description of Artificial Sequence: Synthetic oligonucleotide
  Target: ATXN1; (-) strand; PAM type: NNGRRT; PAM sequence: ACGAAT
taactggattatttggaaac

SEQ ID NO: 17958 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ttttgagtgtaatgtggtaa

SEQ ID NO: 17959 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aactgcctttggttcttttt

SEQ ID NO: 17960 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aaaaaaaaaagcaaaaacgg

SEQ ID NO: 17961 - DNA, 20 bp, Artificial Sequence
  Description of Artificial Sequence: Synthetic oligonucleotide
  Target: ATXN1; (-) strand; PAM type: NNGRRT; PAM sequence: GCGAAT
tacatataaatctataaatg

SEQ ID NO: 17962 - DNA, 20 bp, Artificial Sequence
  Description of Artificial Sequence: Synthetic oligonucleotide
  Target: ATXN1; (-) strand; PAM type: NNGRRT; PAM sequence: GTGAAT
actaagggaatgaacagatt

SEQ ID NO: 17963 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gagtttcattcagttactaa

SEQ ID NO: 17964 - DNA, 20 bp, Artificial Sequence
  Description of Artificial Sequence: Synthetic oligonucleotide
  Target: ATXN1; (-) strand; PAM type: NNGRRT; PAM sequence: GTGAGT
atactccctcgtagccattt

SEQ ID NO: 17965 - DNA, 20 bp, Artificial Sequence
  Description of Artificial Sequence: Synthetic oligonucleotide
  Target: ATXN1; (-) strand; PAM type: NNGRRT; PAM sequence: TAGGAT
cagcttgggcttcagtgaac

SEQ ID NO: 17966 - DNA, 20 bp, Artificial Sequence
  Description of Artificial Sequence: Synthetic oligonucleotide
  Target: ATXN1; (-) strand; PAM type: NNGRRT; PAM sequence: ATGAGT
cttcatcaactatgcttatt

SEQ ID NO: 17967 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gaagggatgactcagagagg

SEQ ID NO: 17968 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ctagcgattctttcactgga

SEQ ID NO: 17969 - DNA, 20 bp, Artificial Sequence
  Description of Artificial Sequence: Synthetic oligonucleotide
  Target: ATXN1; (-) strand; PAM type: NNGRRT; PAM sequence: CAGGGT
atggcatctactttttcagc

SEQ ID NO: 17970 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agtgagtaagctaattttat

SEQ ID NO: 17971 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttctcctttttaaaaattca

SEQ ID NO: 17972 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gtagaaacaagaagtaactc

SEQ ID NO: 17973 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tctcagattctttccctgtc

SEQ ID NO: 17974 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ggaggatgaaaagcatccag

SEQ ID NO: 17975 - DNA, 20 bp, Artificial Sequence
  Description of Artificial Sequence: Synthetic oligonucleotide
  Target: ATXN1; (-) strand; PAM type: NNGRRT; PAM sequence: GAGGAT
agcgggtggagaactgcatg

SEQ ID NO: 17976 - DNA, 20 bp, Artificial Sequence
  Description of Artificial Sequence: Synthetic oligonucleotide
  Target: ATXN1; (-) strand; PAM type: NNGRRT; PAM sequence: GCGGGT
ctttaagtgaggggtagtaa

SEQ ID NO: 17977 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ccaggaccacactttaagtg

SEQ ID NO: 17978 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atagttctagggtggagcct

SEQ ID NO: 17979 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gggttctgatttaatagttc

SEQ ID NO: 17980 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gatttctgggcgccaggccc

SEQ ID NO: 17981 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gatttgacgattacatttta

SEQ ID NO: 17982 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aaagtactgggattataggc

SEQ ID NO: 17983 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gctttggcctcccaaagtac

SEQ ID NO: 17984 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaacctccgcctc

SEQ ID NO: 17985 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctctgtcgcccaggctggca

SEQ ID NO: 17986 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aaggtgggtgggagtgaggg

SEQ ID NO: 17987 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ccgaaaggtgggtgggagtg

SEQ ID NO: 17988 - DNA, 20 bp, Artificial Sequence
  Description of Artificial Sequence: Synthetic oligonucleotide
  Target: ATXN1; (-) strand; PAM type: NNGRRT; PAM sequence: GGGAGT
cctacctccgaaaggtgggt

SEQ ID NO: 17989 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gggcggcctacctccgaaag

SEQ ID NO: 17990 - DNA, 20 bp, Artificial Sequence
  Description of Artificial Sequence: Synthetic oligonucleotide
  Target: ATXN1; (-) strand; PAM type: NNGRRT; PAM sequence: GCGGAT
gctgtgtctcatttcagtca

SEQ ID NO: 17991 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ttctacaaaggcgggtggtg

SEQ ID NO: 17992 - DNA, 20 bp, Artificial Sequence
  Description of Artificial Sequence: Synthetic oligonucleotide
  Target: ATXN1; (-) strand; PAM type: NNGRRT; PAM sequence: GCGGGT
tgggtagctgttctacaaag

SEQ ID NO: 17993 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gacttgctatccttgtcttt

SEQ ID NO: 17994 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aaaggaaaacaatcacaaaa

SEQ ID NO: 17995 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ccatttctgtatttttcaaa

SEQ ID NO: 17996 - DNA, 20 bp, Artificial Sequence
  Description of Artificial Sequence: Synthetic oligonucleotide
  Target: ATXN1; (-) strand; PAM type: NNGRRT; PAM sequence: AGGAAT
acccatcacagagctttcaa

SEQ ID NO: 17997 - DNA, 20 bp, Artificial Sequence
  Description of Artificial Sequence: Synthetic oligonucleotide
  Target: ATXN1; (-) strand; PAM type: NNGRRT; PAM sequence: ATGAGT
agaaaaattagaattacagc

SEQ ID NO: 17998 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cctttgaaacacagaaaaat

SEQ ID NO: 17999 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gatctggataagaattcacc

SEQ ID NO: 18000 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ctcctggaattgatctggat

SEQ ID NO: 18001 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ccgtaactcctggaattgat

SEQ ID NO: 18002 - DNA, 20 bp, Artificial Sequence
  Description of Artificial Sequence: Synthetic oligonucleotide
  Target: ATXN1; (-) strand; PAM type: NNGRRT; PAM sequence: TGGAAT
attccacgccccgtaactcc

SEQ ID NO: 18003 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gtttctgtgacttgatggca

SEQ ID NO: 18004 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gcaacagacaaggcacaaat

SEQ ID NO: 18005 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ttagggaaggagaggggaga

SEQ ID NO: 18006 - DNA, 20 bp, Artificial Sequence
  Description of Artificial Sequence: Synthetic oligonucleotide
  Target: ATXN1; (-) strand; PAM type: NNGRRT; PAM sequence: GGGGAT
taatggggccagggtgggca

SEQ ID NO: 18007 - DNA, 20 bp, Artificial Sequence
  Description of Artificial Sequence: Synthetic oligonucleotide
  Target: ATXN1; (-) strand; PAM type: NNGRRT; PAM sequence: CAGGGT
caagtgagaaataatggggc

SEQ ID NO: 18008 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tggacgatgagttcaaaagg

SEQ ID NO: 18009 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gatttgacccagtgtggacg

SEQ ID NO: 18010 - DNA, 20 bp, Artificial Sequence
  Description of Artificial Sequence: Synthetic oligonucleotide
  Target: ATXN1; (-) strand; PAM type: NNGRRT; PAM sequence: GCGGAT
agctattgtaatgattttta

SEQ ID NO: 18011 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gtagcatggggccaggctga

SEQ ID NO: 18012 - DNA, 20 bp, Artificial Sequence
  Description of Artificial Sequence: Synthetic oligonucleotide
  Target: ATXN1; (-) strand; PAM type: NNGRRT; PAM sequence: AAGAGT
atttaacatacctcagctgt

SEQ ID NO: 18013 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttaacacatgttataggttc

SEQ ID NO: 18014 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ggcagtagtcatgaaatttt

SEQ ID NO: 18015 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cttcttgatcaacagatatt

SEQ ID NO: 18016 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgatattgtaagtcattagc

SEQ ID NO: 18017 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tggtctgtagatttggtcat

SEQ ID NO: 18018 - DNA, 20 bp, Artificial Sequence
  Description of Artificial Sequence: Synthetic oligonucleotide
  Target: ATXN1; (-) strand; PAM type: NNGRRT; PAM sequence: AGGGGT
tggactttggcttatattct

SEQ ID NO: 18019 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ttacggcatttcaaatgcta

SEQ ID NO: 18020 - DNA, 20 bp, Artificial Sequence
  Description of Artificial Sequence: Synthetic oligonucleotide
  Target: ATXN1; (-) strand; PAM type: NNGRRT; PAM sequence: TGGGGT
agggcttaggggacgtggta

SEQ ID NO: 18021 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tgcatggtatccagtaattt

SEQ ID NO: 18022 - DNA, 20 bp, Artificial Sequence
  Description of Artificial Sequence: Synthetic oligonucleotide
  Target: ATXN1; (-) strand; PAM type: NNGRRT; PAM sequence: TTGAGT
atggctgtggtcctctaggc

SEQ ID NO: 18023 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gagattgagttcttcaggta

SEQ ID NO: 18024 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gagctctgtctcaaaggaga

SEQ ID NO: 18025 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tgttgtcaggaatggctcca

SEQ ID NO: 18026 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gagtgggtgggggtgttgtc

SEQ ID NO: 18027 - DNA, 20 bp, Artificial Sequence
  Description of Artificial Sequence: Synthetic oligonucleotide
  Target: ATXN1; (-) strand; PAM type: NNGRRT; PAM sequence: GGGGGT
taatttagccttgagtgggt

SEQ ID NO: 18028 - DNA, 20 bp, Artificial Sequence
  Description of Artificial Sequence: Synthetic oligonucleotide
  Target: ATXN1; (-) strand; PAM type: NNGRRT; PAM sequence: GTGGGT
atgcgttaatttagccttga

SEQ ID NO: 18029 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aaggatgcgttaatttagcc

SEQ ID NO: 18030 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ggactgtgatcatatggacg

SEQ ID NO: 18031 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ccttgggaagtttggatgag

SEQ ID NO: 18032 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aatccctgcccttgggaagt

SEQ ID NO: 18033 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aacagtacctaccatatttc

SEQ ID NO: 18034 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttctacttttggaggacgtt

SEQ ID NO: 18035 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aacaaacagaagatcagaga

SEQ ID NO: 18036 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gtctatacctttgcacgtca

SEQ ID NO: 18037 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ctacactggcagaatttgat

SEQ ID NO: 18038 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cagtttttgcactacactgg

SEQ ID NO: 18039 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aggaggcattcatccagacc

SEQ ID NO: 18040 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttcatatcaagctctgtgaa

SEQ ID NO: 18041 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tttggaatggatagaggctt

SEQ ID NO: 18042 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttcttataagtccctttgga

SEQ ID NO: 18043 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtccttcttataagtccctt

SEQ ID NO: 18044 - DNA, 20 bp, Artificial Sequence
  Description of Artificial Sequence: Synthetic oligonucleotide
  Target: ATXN1; (-) strand; PAM type: NNGRRT; PAM sequence: GGGAAT
cgttgtcaagttcttggttg

SEQ ID NO: 18045 - DNA, 20 bp, Artificial Sequence
  Description of Artificial Sequence: Synthetic oligonucleotide
  Target: ATXN1; (-) strand; PAM type: NNGRRT; PAM sequence: AGGGGT
catcaggtgctggctggggc

SEQ ID NO: 18046 - DNA, 20 bp, Artificial Sequence
  Description of Artificial Sequence: Synthetic oligonucleotide
  Target: ATXN1; (-) strand; PAM type: NNGRRT; PAM sequence: TAGGGT
actccctacagtcatctcac

SEQ ID NO: 18047 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ctctctgttcatctcaggag

SEQ ID NO: 18048 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aatcggaacaagggagtggg

SEQ ID NO: 18049 - DNA, 20 bp, Artificial Sequence
  Description of Artificial Sequence: Synthetic oligonucleotide
  Target: ATXN1; (-) strand; PAM type: NNGRRT; PAM sequence: TGGGAT
agggaatcggaacaagggag

SEQ ID NO: 18050 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tgagcagggaatcggaacaa

SEQ ID NO: 18051 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aggtgtttgcttggtgagca

SEQ ID NO: 18052 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctctctaaggaagatccata

SEQ ID NO: 18053 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ctctctgtgttaagctgcat

SEQ ID NO: 18054 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gacccacgagatcgttatgc

SEQ ID NO: 18055 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gagctatgccacagatgagc

SEQ ID NO: 18056 - DNA, 20 bp, Artificial Sequence
  Description of Artificial Sequence: Synthetic oligonucleotide
  Target: ATXN1; (-) strand; PAM type: NNGRRT; PAM sequence: CTGGAT
atgctgtcagcgagggctgg

SEQ ID NO: 18057 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tctgtgaaaatcagttgaaa

SEQ ID NO: 18058 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gccagtcactaattggtact

SEQ ID NO: 18059 - DNA, 20 bp, Artificial Sequence
  Description of Artificial Sequence: Synthetic oligonucleotide
  Target: ATXN1; (-) strand; PAM type: NNGRRT; PAM sequence: TGGAAT
acaggcactgaccttctttc

SEQ ID NO: 18060 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tctggaacagaaggagaaaa

SEQ ID NO: 18061 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cttactcccttggttcttct

SEQ ID NO: 18062 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ataatatatttaattcctag

SEQ ID NO: 18063 - DNA, 20 bp, Artificial Sequence
  Description of Artificial Sequence: Synthetic oligonucleotide
  Target: ATXN1; (-) strand; PAM type: NNGRRT; PAM sequence: ATGAAT
atgctacataccttcactta

SEQ ID NO: 18064 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aagccacttcccaaattatg

SEQ ID NO: 18065 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gagtccccgggaaataaaga

SEQ ID NO: 18066 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aatgttatgggaaataaaga

SEQ ID NO: 18067 - DNA, 20 bp, Artificial Sequence
  Description of Artificial Sequence: Synthetic oligonucleotide
  Target: ATXN1; (-) strand; PAM type: NNGRRT; PAM sequence: ATGAAT
attgcgttgatattgtggag

SEQ ID NO: 18068 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gaatttttgatgtagaaata

SEQ ID NO: 18069 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgtatgtttatccttccctg

SEQ ID NO: 18070 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tctttcttcctgtgctttgg

SEQ ID NO: 18071 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gcgacatttagctgtttagc

SEQ ID NO: 18072 - DNA, 20 bp, Artificial Sequence
  Description of Artificial Sequence: Synthetic oligonucleotide
  Target: ATXN1; (-) strand; PAM type: NNGRRT; PAM sequence: TCGGGT
cctgactggcagattcgctg

SEQ ID NO: 18073 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gagagcctatctcagctgtc

SEQ ID NO: 18074 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gctggaaaaggaaggacagg

SEQ ID NO: 18075 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tcttagaagaacagtggtca

SEQ ID NO: 18076 - DNA, 20 bp, Artificial Sequence
  Description of Artificial Sequence: Synthetic oligonucleotide
  Target: ATXN1; (-) strand; PAM type: NNGRRT; PAM sequence: AGGAAT
acttggtgggttaaaacaac

SEQ ID NO: 18077 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aataaattaccagaaacttg

SEQ ID NO: 18078 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gatctagaggctgcaggagc

SEQ ID NO: 18079 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tctgaggccagaaggagcct

SEQ ID NO: 18080 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggatgagcactgtaaaggaa

SEQ ID NO: 18081 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gaagggtgagatgagaatct

SEQ ID NO: 18082 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggagtggtgaagggtgagat

SEQ ID NO: 18083 - DNA, 20 bp, Artificial Sequence
  Description of Artificial Sequence: Synthetic oligonucleotide
  Target: ATXN1; (-) strand; PAM type: NNGRRT; PAM sequence: AAGGGT
cctggaagatgggagtggtg

SEQ ID NO: 18084 - DNA, 20 bp, Artificial Sequence
  Description of Artificial Sequence: Synthetic oligonucleotide
  Target: ATXN1; (-) strand; PAM type: NNGRRT; PAM sequence: GGGAGT
aggagccagccctggaagat

SEQ ID NO: 18085 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tggagtcagggaaagtctta

SEQ ID NO: 18086 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aaggggattcttttgtttgg

SEQ ID NO: 18087 - DNA, 20 bp, Artificial Sequence
  Description of Artificial Sequence: Synthetic oligonucleotide
  Target: ATXN1; (-) strand; PAM type: NNGRRT; PAM sequence: GGGGAT
agagtgatggcaggggcgaa

SEQ ID NO: 18088 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gagtaggatatgttaggaga

SEQ ID NO: 18089 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gcagaccccccaaaatagag

SEQ ID NO: 18090 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tatttgcagaccccccaaaa

SEQ ID NO: 18091 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cttatacaaccaagtattta

SEQ ID NO: 18092 - DNA, 20 bp, Artificial Sequence
  Description of Artificial Sequence: Synthetic oligonucleotide
  Target: ATXN1; (-) strand; PAM type: NNGRRT; PAM sequence: TTGAGT
atcaagtcaggcttttataa

SEQ ID NO: 18093 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cattcttgacttgcaatgca

SEQ ID NO: 18094 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aaaagccatgtttggatcaa

SEQ ID NO: 18095 - DNA, 20 bp, Artificial Sequence
  Description of Artificial Sequence: Synthetic oligonucleotide
  Target: ATXN1; (-) strand; PAM type: NNGRRT; PAM sequence: TTGGAT
taaaagcaaaaaagccatgt

SEQ ID NO: 18096 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gctcacatagctggtaggaa

SEQ ID NO: 18097 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ttcttttctacaggctcaaa

SEQ ID NO: 18098 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tgggttctcatagcagccct

SEQ ID NO: 18099 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ttgctggatgggttacctca

SEQ ID NO: 18100 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ctaaagaaatattttgctgg

SEQ ID NO: 18101 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gcatctaaagaaatattttg

SEQ ID NO: 18102 - DNA, 20 bp, Artificial Sequence
  Description of Artificial Sequence: Synthetic oligonucleotide
  Target: ATXN1; (-) strand; PAM type: NNGRRT; PAM sequence: CTGGGT
taaggacagacatttcttgc

SEQ ID NO: 18103 - DNA, 20 bp, Artificial Sequence
  Description of Artificial Sequence: Synthetic oligonucleotide
  Target: ATXN1; (-) strand; PAM type: NNGRRT; PAM sequence: CTGGGT
acgggggagctggttatcct

SEQ ID NO: 18104 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tattaataggtatgcagagc

SEQ ID NO: 18105 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttggggaaatgtgtgagtaa

SEQ ID NO: 18106 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aggaacatttggggaaatgt

SEQ ID NO: 18107 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggtttgtggcatccacattt

SEQ ID NO: 18108 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aatgaaaaggaataatgttt

SEQ ID NO: 18109 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tttcttttgaaataatgaaa

SEQ ID NO: 18110 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctcagcctcccaaagtgc

SEQ ID NO: 18111 - DNA, 20 bp, Artificial Sequence
  Description of Artificial Sequence: Synthetic oligonucleotide
  Target: ATXN1; (-) strand; PAM type: NNGRRT; PAM sequence: CCGAAT
agtcctcttgttccagcctc

SEQ ID NO: 18112 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctccctctatcaccctggc

SEQ ID NO: 18113 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tttatttattttttaagagg

SEQ ID NO: 18114 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggcttaacaaaatgttaagg

SEQ ID NO: 18115 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gttcataggaaccatttatt

SEQ ID NO: 18116 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agctttcaatcagatcctcc

SEQ ID NO: 18117 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gtatgtgggtttttctggga

SEQ ID NO: 18118 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagcatgacattctgtgtat

SEQ ID NO: 18119 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gccactgcaataaggtggtt

SEQ ID NO: 18120 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gcagtggtcaggtgaggcca

SEQ ID NO: 18121 - DNA, 20 bp, Artificial Sequence
  Description of Artificial Sequence: Synthetic oligonucleotide
  Target: ATXN1; (-) strand; PAM type: NNGRRT; PAM sequence: ACGAAT
tgtgtaggctggctagaaga

SEQ ID NO: 18122 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gtttgcaacatgatattgct

SEQ ID NO: 18123 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gcattgggaggtcatggcta

SEQ ID NO: 18124 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gtggaacatgtaaatgcatt

SEQ ID NO: 18125 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tagtgagatggttcagtgta

SEQ ID NO: 18126 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttttattatcgttatttact

SEQ ID NO: 18127 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tgtagatgtttcctgttatt

SEQ ID NO: 18128 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tataatttgacatattttct

SEQ ID NO: 18129 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gtgttgactcactaaagaac

SEQ ID NO: 18130 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gtatttgcgtgtgtgtgaga

SEQ ID NO: 18131 - DNA, 20 bp, Artificial Sequence
  Description of Artificial Sequence: Synthetic oligonucleotide
  Target: ATXN1; (-) strand; PAM type: NNGRRT; PAM sequence: TTGGGT
atcacacacattcagagttg

SEQ ID NO: 18132 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tacgcatgatcacacacatt

SEQ ID NO: 18133 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cagtgacttttaatccttag

SEQ ID NO: 18134 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tatgttactctatctctgga

SEQ ID NO: 18135 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gaaggatagattgttgttta

SEQ ID NO: 18136 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tgaactcatttcaactgcag

SEQ ID NO: 18137 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aagttatgtgtaagctgact

SEQ ID NO: 18138 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ttgtctcttcctcctccttt

SEQ ID NO: 18139 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttatctataaaagattgtac

SEQ ID NO: 18140 - DNA, 20 bp, Artificial Sequence
  Description of Artificial Sequence: Synthetic oligonucleotide
  Target: ATXN1; (-) strand; PAM type: NNGRRT; PAM sequence: AGGGGT
taaataaaaggtttatccaa

SEQ ID NO: 18141 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aacttattctgttgaatgca

SEQ ID NO: 18142 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aaacattggaacttattctg

SEQ ID NO: 18143 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gtgtaattatcttaatgctc

SEQ ID NO: 18144 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ggctatttttttaatggctt

SEQ ID NO: 18145 - DNA, 20 bp, Artificial Sequence
  Description of Artificial Sequence: Synthetic oligonucleotide
  Target: ATXN1; (-) strand; PAM type: NNGRRT; PAM sequence: ATGAAT
acagtcgagtgaaaatggac

SEQ ID NO: 18146 - DNA, 20 bp, Artificial Sequence
  Description of Artificial Sequence: Synthetic oligonucleotide
  Target: ATXN1; (-) strand; PAM type: NNGRRT; PAM sequence: TCGAGT
cttatgttaaaaaaacacag

SEQ ID NO: 18147 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtctcttttatgatttgtgt

SEQ ID NO: 18148 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gaacttccagtctgaggcat

SEQ ID NO: 18149 - DNA, 20 bp, Artificial Sequence
  Description of Artificial Sequence: Synthetic oligonucleotide
  Target: ATXN1; (-) strand; PAM type: NNGRRT; PAM sequence: CGGGGT
taaagggaatgccagtcact

SEQ ID NO: 18150 - DNA, 20 bp, Artificial Sequence
  Description of Artificial Sequence: Synthetic oligonucleotide
  Target: ATXN1; (-) strand; PAM type: NNGRRT; PAM sequence: GGGAAT
agacacactgcccagttaaa

SEQ ID NO: 18151 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaaattcttttggagacttc

SEQ ID NO: 18152 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gaactgaaagccctaggcac

SEQ ID NO: 18153 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcgtctctcaggggtgaaca

SEQ ID NO: 18154 - DNA, 20 bp, Artificial Sequence
  Description of Artificial Sequence: Synthetic oligonucleotide
  Target: ATXN1; (-) strand; PAM type: NNGRRT; PAM sequence: AGGGGT
aagtgcacaggtcgtctctc

SEQ ID NO: 18155 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atttagttgcctgtgatgga

SEQ ID NO: 18156 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tgtatatttagttgcctgtg

SEQ ID NO: 18157 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ggctgtttttcaccctgttc

SEQ ID NO: 18158 - DNA, 20 bp, Artificial Sequence
  Description of Artificial Sequence: Synthetic oligonucleotide
  Target: ATXN1; (-) strand; PAM type: NNGRRT; PAM sequence: CTGAAT
attgtacatagaactcgggt

SEQ ID NO: 18159 - DNA, 20 bp, Artificial Sequence
  Description of Artificial Sequence: Synthetic oligonucleotide
  Target: ATXN1; (-) strand; PAM type: NNGRRT; PAM sequence: TCGGGT
aaacctattgtacatagaac

SEQ ID NO: 18160 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tatgtcaaattataaagcct

SEQ ID NO: 18161 - DNA, 20 bp, Artificial Sequence
  Description of Artificial Sequence: Synthetic oligonucleotide
  Target: ATXN1; (-) strand; PAM type: NNGRRT; PAM sequence: CGGGAT
tgactgagctcaggccatgg

SEQ ID NO: 18162 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tctgacctgccttctctcaa

SEQ ID NO: 18163 - DNA, 20 bp, Artificial Sequence
  Description of Artificial Sequence: Synthetic oligonucleotide
  Target: ATXN1; (-) strand; PAM type: NNGRRT; PAM sequence: AGGGAT
actttcattttaattttcca

SEQ ID NO: 18164 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgtacttaagaaggctctag

SEQ ID NO: 18165 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ggaatgaaaacacgcagtat

SEQ ID NO: 18166 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aattaacaatcacactcctc

SEQ ID NO: 18167 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tgtgtagttcatgcttttct

SEQ ID NO: 18168 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aatcccccatgtctttagca

SEQ ID NO: 18169 - DNA, 20 bp, Artificial Sequence
  Description of Artificial Sequence: Synthetic oligonucleotide
  Target: ATXN1; (-) strand; PAM type: NNGRRT; PAM sequence: GAGAGT
atttaccctgaattgaatgg

SEQ ID NO: 18170 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ctgaacaaatttaccctgaa

SEQ ID NO: 18171 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttcatctgaacaaatttacc

SEQ ID NO: 18172 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ttcggtttctgattcaaaaa

SEQ ID NO: 18173 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tactgggccaaatatgcaca

SEQ ID NO: 18174 - DNA, 20 bp, Artificial Sequence
  Description of Artificial Sequence: Synthetic oligonucleotide
  Target: ATXN1; (-) strand; PAM type: NNGRRT; PAM sequence: GGGAGT
attgttgaatgtgagaatgt

SEQ ID NO: 18175 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gcataaatattgttgaatgt

SEQ ID NO: 18176 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttatctgggcataaatattg

SEQ ID NO: 18177 - DNA, 20 bp, Artificial Sequence
  Description of Artificial Sequence: Synthetic oligonucleotide
  Target: ATXN1; (-) strand; PAM type: NNGRRT; PAM sequence: AAGGAT
taaacatagtcagcttgtga

SEQ ID NO: 18178 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aaaatggtgcaggaaaatgt

SEQ ID NO: 18179 - DNA, 20 bp, Artificial Sequence
  Description of Artificial Sequence: Synthetic oligonucleotide
  Target: ATXN1; (-) strand; PAM type: NNGRRT; PAM sequence: TTGAGT
attaaaaaggtctgtatgta

SEQ ID NO: 18180 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tgttccttgtgtacttggat

SEQ ID NO: 18181 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tgcacttgttccttgtgtac

SEQ ID NO: 18182 - DNA, 20 bp, Artificial Sequence
  Description of Artificial Sequence: Synthetic oligonucleotide
  Target: ATXN1; (-) strand; PAM type: NNGRRT; PAM sequence: AGGAGT
atgtgggtattgtggggagg

SEQ ID NO: 18183 - DNA, 20 bp, Artificial Sequence
  Description of Artificial Sequence: Synthetic oligonucleotide
  Target: ATXN1; (-) strand; PAM type: NNGRRT; PAM sequence: GTGGGT
atggccaaaaggaaaattat

SEQ ID NO: 18184 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gcttcatcttaatatggtga

SEQ ID NO: 18185 - DNA, 20 bp, Artificial Sequence
  Description of Artificial Sequence: Synthetic oligonucleotide
  Target: ATXN1; (-) strand; PAM type: NNGRRT; PAM sequence: CAGGGT
cccctccctcttacagttca

SEQ ID NO: 18186 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccttggcctcccaaagtgc

SEQ ID NO: 18187 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tttttgtattttagtagaga

SEQ ID NO: 18188 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagccacctgtgtagc

SEQ ID NO: 18189 - DNA, 20 bp, Artificial Sequence
  Description of Artificial Sequence: Synthetic oligonucleotide
  Target: ATXN1; (-) strand; PAM type: NNGRRT; PAM sequence: CCGGGT
tcactgcagcctctgctccc

SEQ ID NO: 18190 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctgccacccagac

SEQ ID NO: 18191 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttttttttttttttttgaga

SEQ ID NO: 18192 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ttattctatgtcatacataa

SEQ ID NO: 18193 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttttgtctttttagtagaga

SEQ ID NO: 18194 - DNA, 20 bp, Artificial Sequence
  Description of Artificial Sequence: Synthetic oligonucleotide
  Target: ATXN1; (-) strand; PAM type: NNGRRT; PAM sequence: TGGGAT
agcctcctgagtagagtagc

SEQ ID NO: 18195 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttctgcctcagcctcctgag

SEQ ID NO: 18196 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gattcttctgcctcagcctc

SEQ ID NO: 18197 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttcgctcttgtcgcccaggc

SEQ ID NO: 18198 - DNA, 20 bp, Artificial Sequence
  Description of Artificial Sequence: Synthetic oligonucleotide
  Target: ATXN1; (-) strand; PAM type: NNGRRT; PAM sequence: TAGGGT
cttcataattgaaaaggctt

SEQ ID NO: 18199 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tctcttacctactagtatat

SEQ ID NO: 18200 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ttcagcatcaaacctcactt

SEQ ID NO: 18201 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gtcttctctgagcccagtta

SEQ ID NO: 18202 - DNA, 20 bp, Artificial Sequence
  Description of Artificial Sequence: Synthetic oligonucleotide
  Target: ATXN1; (-) strand; PAM type: NNGRRT; PAM sequence: GAGAGT
atttttttataagtacttaa

SEQ ID NO: 18203 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gtcacagactaataacagct

SEQ ID NO: 18204 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agtccgaatttgtggacaca

SEQ ID NO: 18205 - DNA, 20 bp, Artificial Sequence
  Description of Artificial Sequence: Synthetic oligonucleotide
  Target: ATXN1; (-) strand; PAM type: NNGRRT; PAM sequence: CCGAAT
aattttgatcattttatagt

SEQ ID NO: 18206 - DNA, 20 bp, Artificial Sequence
  Description of Artificial Sequence: Synthetic oligonucleotide
  Target: ATXN1; (-) strand; PAM type: NNGRRT; PAM sequence: ACGAAT
aatggaggaaacggtctctg

SEQ ID NO: 18207 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggtgaataagtatggcccga

SEQ ID NO: 18208 - DNA, 20 bp, Artificial Sequence
  Description of Artificial Sequence: Synthetic oligonucleotide
  Target: ATXN1; (-) strand; PAM type: NNGRRT; PAM sequence: CCGAAT
agatggtgaataagtatggc

SEQ ID NO: 18209 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ccattttagagtagtagatg

SEQ ID NO: 18210 - DNA, 20 bp, Artificial Sequence
  Description of Artificial Sequence: Synthetic oligonucleotide
  Target: ATXN1; (-) strand; PAM type: NNGRRT; PAM sequence: TAGAGT
cccttgcagcttccccattt

SEQ ID NO: 18211 - DNA, 20 bp, Artificial Sequence
  Description of Artificial Sequence: Synthetic oligonucleotide
  Target: ATXN1; (-) strand; PAM type: NNGRRT; PAM sequence: GAGGGT
acagcctcctcatgcaaaat

SEQ ID NO: 18212 - DNA, 20 bp, Artificial Sequence
  Description of Artificial Sequence: Synthetic oligonucleotide
  Target: ATXN1; (-) strand; PAM type: NNGRRT; PAM sequence: CAGGGT
cctttgcctcctttcagctc

SEQ ID NO: 18213 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ccccactgtccatgcccagc

SEQ ID NO: 18214 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tgaccaccctgctttgctgt

SEQ ID NO: 18215 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gggagaccttgagttgtaga

SEQ ID NO: 18216 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gagttggtgagagggagacc

SEQ ID NO: 18217 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atatgggtgatggcgtgtag

SEQ ID NO: 18218 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tagggcaaaataccaggcat

SEQ ID NO: 18219 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atgatattaccattctcctt

SEQ ID NO: 18220 - DNA, 20 bp, Artificial Sequence
  Description of Artificial Sequence: Synthetic oligonucleotide
  Target: ATXN1; (-) strand; PAM type: NNGRRT; PAM sequence: GGGGAT
agtttcttcatctgaagagt

SEQ ID NO: 18221 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgcctcagtttcttcatctg

SEQ ID NO: 18222 - DNA, 20 bp, Artificial Sequence
  Description of Artificial Sequence: Synthetic oligonucleotide
  Target: ATXN1; (-) strand; PAM type: NNGRRT; PAM sequence: TCGAAT
aattttgatatctctctagt

SEQ ID NO: 18223 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tcatctgtggttgggtatac

SEQ ID NO: 18224 - DNA, 20 bp, Artificial Sequence
  Description of Artificial Sequence: Synthetic oligonucleotide
  Target: ATXN1; (-) strand; PAM type: NNGRRT; PAM sequence: TTGGGT
cctgcgtccctcatctgtgg

SEQ ID NO: 18225 - DNA, 20 bp, Artificial Sequence
  Description of Artificial Sequence: Synthetic oligonucleotide
  Target: ATXN1; (-) strand; PAM type: NNGRRT; PAM sequence: TGGGAT
atgccaagctgtcctgcagc

SEQ ID NO: 18226 - DNA, 20 bp, Artificial Sequence
  Description of Artificial Sequence: Synthetic oligonucleotide
  Target: ATXN1; (-) strand; PAM type: NNGRRT; PAM sequence: GGGAAT
agaagctgggtgacggggaa

SEQ ID NO: 18227 - DNA, 20 bp, Artificial Sequence
  Description of Artificial Sequence: Synthetic oligonucleotide
  Target: ATXN1; (-) strand; PAM type: NNGRRT; PAM sequence: CTGGGT
agaatgggaaggaatagaag

SEQ ID NO: 18228 - DNA, 20 bp, Artificial Sequence
  Description of Artificial Sequence: Synthetic oligonucleotide
  Target: ATXN1; (-) strand; PAM type: NNGRRT; PAM sequence: AGGAAT
taaatagaaggagaatggga

SEQ ID NO: 18229 - DNA, 20 bp, Artificial Sequence
  Description of Artificial Sequence: Synthetic oligonucleotide
  Target: ATXN1; (-) strand; PAM type: NNGRRT; PAM sequence: GAGAAT
taactaggaataaatagaag

SEQ ID NO: 18230 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cttaaaaattcttagtaact

SEQ ID NO: 18231 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gtccctaaagaaccttccct

SEQ ID NO: 18232 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttctcagatgtctgctgtgt

SEQ ID NO: 18233 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttctgtaggaagacttgttt

SEQ ID NO: 18234 - DNA, 20 bp, Artificial Sequence
  Description of Artificial Sequence: Synthetic oligonucleotide
  Target: ATXN1; (-) strand; PAM type: NNGRRT; PAM sequence: GAGGAT
agatactttgtacagtaaag

SEQ ID NO: 18235 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aatatacaccttgggagaat

SEQ ID NO: 18236 - DNA, 20 bp, Artificial Sequence
  Description of Artificial Sequence: Synthetic oligonucleotide
  Target: ATXN1; (-) strand; PAM type: NNGRRT; PAM sequence: GAGAAT
catataaatatacaccttgg

SEQ ID NO: 18237 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gtcccagatgcagtttcagg

SEQ ID NO: 18238 - DNA, 20 bp, Artificial Sequence
  Description of Artificial Sequence: Synthetic oligonucleotide
  Target: ATXN1; (-) strand; PAM type: NNGRRT; PAM sequence: CAGGGT
cggagtcccagatgcagttt

SEQ ID NO: 18239 - DNA, 20 bp, Artificial Sequence
  Description of Artificial Sequence: Synthetic oligonucleotide
  Target: ATXN1; (-) strand; PAM type: NNGRRT; PAM sequence: CGGAGT
tgttattcagagcttgactc

SEQ ID NO: 18240 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cgaacgaaagaatacaggct

SEQ ID NO: 18241 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aatgcctaaaattcgaacga

SEQ ID NO: 18242 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cctccatgagggttggatgg

SEQ ID NO: 18243 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ctcagagacctccatgaggg

SEQ ID NO: 18244 - DNA, 20 bp, Artificial Sequence
  Description of Artificial Sequence: Synthetic oligonucleotide
  Target: ATXN1; (-) strand; PAM type: NNGRRT; PAM sequence: GAGGGT
cccaactcagagacctccat

SEQ ID NO: 18245 - DNA, 20 bp, Artificial Sequence
  Description of Artificial Sequence: Synthetic oligonucleotide
  Target: ATXN1; (-) strand; PAM type: NNGRRT; PAM sequence: CAGAAT
caggaatcaggtgggagggc

SEQ ID NO: 18246 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agggccattttctctgtgtc

SEQ ID NO: 18247 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaaattgc

SEQ ID NO: 18248 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ttttgtatttttagtagaga

SEQ ID NO: 18249 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gattctcctgccccagcctc

SEQ ID NO: 18250 - DNA, 20 bp, Artificial Sequence
  Description of Artificial Sequence: Synthetic oligonucleotide
  Target: ATXN1; (-) strand; PAM type: NNGRRT; PAM sequence: CCGGGT
gtcactgtaatgtccatctc

SEQ ID NO: 18251 - DNA, 20 bp, Artificial Sequence
  Description of Artificial Sequence: Synthetic oligonucleotide
  Target: ATXN1; (-) strand; PAM type: NNGRRT; PAM sequence: TGGGGT
actcactctgttgcccaggc

SEQ ID NO: 18252 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agggatttttagtgataatc

SEQ ID NO: 18253 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tccctaacttctacctataa

SEQ ID NO: 18254 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aatattctttctgtattttg

SEQ ID NO: 18255 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gcaagaatacaatcttcagg

SEQ ID NO: 18256 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gttaggaaagaacagtgggc

SEQ ID NO: 18257 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cactgacttgaaatttgacc

SEQ ID NO: 18258 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agctacttttaaatacacaa

SEQ ID NO: 18259 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gtggcacctgtgataggtcc

SEQ ID NO: 18260 - DNA, 20 bp, Artificial Sequence
  Description of Artificial Sequence: Synthetic oligonucleotide
  Target: ATXN1; (-) strand; PAM type: NNGRRT; PAM sequence: GGGAGT
cagttatacagtgtctttca

SEQ ID NO: 18261 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gttgcacttaaagggaaaaa

SEQ ID NO: 18262 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ttttgcacaaactgcttctc

SEQ ID NO: 18263 - DNA, 20 bp, Artificial Sequence
  Description of Artificial Sequence: Synthetic oligonucleotide
  Target: ATXN1; (-) strand; PAM type: NNGRRT; PAM sequence: CGGGGT
atacgggtcttatcttagaa

SEQ ID NO: 18264 - DNA, 20 bp, Artificial Sequence
  Description of Artificial Sequence: Synthetic oligonucleotide
  Target: ATXN1; (-) strand; PAM type: NNGRRT; PAM sequence: ACGGGT
tcttccctggctctgttaat

SEQ ID NO: 18265 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ctgaatgcatcttgcactcc

SEQ ID NO: 18266 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gcttgtgatgtttttttccc

SEQ ID NO: 18267 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ttcaagctcctgaaagcaag

SEQ ID NO: 18268 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcaaagtacagacaacttcc

SEQ ID NO: 18269 - DNA, 20 bp, Artificial Sequence
  Description of Artificial Sequence: Synthetic oligonucleotide
  Target: ATXN1; (-) strand; PAM type: NNGRRT; PAM sequence: GGGGGT
aatgccagtgtaggaggggt

SEQ ID NO: 18270 - DNA, 20 bp, Artificial Sequence
  Description of Artificial Sequence: Synthetic oligonucleotide
  Target: ATXN1; (-) strand; PAM type: NNGRRT; PAM sequence: AGGGGT
acagagaatgccagtgtagg

SEQ ID NO: 18271 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aaacagattctttgaccaca

SEQ ID NO: 18272 - DNA, 20 bp, Artificial Sequence
  Description of Artificial Sequence: Synthetic oligonucleotide
  Target: ATXN1; (-) strand; PAM type: NNGRRT; PAM sequence: TAGAGT
taaatagcacaggaaatgtg

SEQ ID NO: 18273 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ctttagagcaaataattgct

SEQ ID NO: 18274 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tctgtgacagctattactat

SEQ ID NO: 18275 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tgccggtttaaaagccgtgt

SEQ ID NO: 18276 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aaagtcttggcaaatgtagc

SEQ ID NO: 18277 - DNA, 20 bp, Artificial Sequence
  Description of Artificial Sequence: Synthetic oligonucleotide
  Target: ATXN1; (-) strand; PAM type: NNGRRT; PAM sequence: CGGAGT
cgtgagccaccacacccggc

SEQ ID NO: 18278 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcctaaagtgc

SEQ ID NO: 18279 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttgtattttcagtagaga

SEQ ID NO: 18280 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gcctcagcctccaaagtagc

SEQ ID NO: 18281 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cttattgcaacctctgcctc

SEQ ID NO: 18282 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctctgttacccagacttgag

SEQ ID NO: 18283 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tctcactctgttacccagac

SEQ ID NO: 18284 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttttttgtgtgtgtgtgaga

SEQ ID NO: 18285 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tgatttggagctttatcaaa

SEQ ID NO: 18286 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ttaatgcagtcttagctgtt

SEQ ID NO: 18287 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcatcggttggaaaatatgt

SEQ ID NO: 18288 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tcccggcatggcaggaataa

SEQ ID NO: 18289 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agaatgggtcccggcatggc

SEQ ID NO: 18290 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tggtgggtgtaaaactcaga

SEQ ID NO: 18291 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ggtatggtgggtgtaaaact

SEQ ID NO: 18292 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aagtagtaatacctggtatg

SEQ ID NO: 18293 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cacaatcaaaaaccattaag

SEQ ID NO: 18294 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgt

SEQ ID NO: 18295 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttaaaatttttttgtagaga

SEQ ID NO: 18296 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcagtctgttgtccgaac

SEQ ID NO: 18297 - DNA, 20 bp, Artificial Sequence
  Description of Artificial Sequence: Synthetic oligonucleotide
  Target: ATXN1; (-) strand; PAM type: NNGRRT; PAM sequence: CGGGAT
acctcggcctcccaaagtac

SEQ ID NO: 18298 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttagtcaaga

SEQ ID NO: 18299 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaagtagc

SEQ ID NO: 18300 - DNA, 20 bp, Artificial Sequence
  Description of Artificial Sequence: Synthetic oligonucleotide
  Target: ATXN1; (-) strand; PAM type: NNGRRT; PAM sequence: CCGGAT
ctcactgtaacctctccctc

SEQ ID NO: 18301 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttgctcttgttgcccaggc

SEQ ID NO: 18302 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tggttctttttcatttgaga

SEQ ID NO: 18303 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gcgtcagcctccggagtggc

SEQ ID NO: 18304 - DNA, 20 bp, Artificial Sequence
  Description of Artificial Sequence: Synthetic oligonucleotide
  Target: ATXN1; (-) strand; PAM type: NNGRRT; PAM sequence: CGGAGT
gattctcctgcgtcagcctc

SEQ ID NO: 18305 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctcactgcaatctccgcctc

SEQ ID NO: 18306 - DNA, 20 bp, Artificial Sequence
  Description of Artificial Sequence: Synthetic oligonucleotide
  Target: ATXN1; (-) strand; PAM type: NNGRRT; PAM sequence: TGGAGT
actctgtcggttgcctaggc

SEQ ID NO: 18307 - DNA, 20 bp, Artificial Sequence
  Description of Artificial Sequence: Synthetic oligonucleotide
  Target: ATXN1; (-) strand; PAM type: NNGRRT; PAM sequence: TGGGGT
atagacattttttttttata

SEQ ID NO: 18308 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tagcaaacagaacacctgag

SEQ ID NO: 18309 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ccagtgtcatgactagtgtt

SEQ ID NO: 18310 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tgaaggcgagcgttccttgc

SEQ ID NO: 18311 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcatggagaacaaagaagaa

SEQ ID NO: 18312 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctacactccagcctgagcga

SEQ ID NO: 18313 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcaggaggctgaggcag

SEQ ID NO: 18314 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgagaggccaaggcag

SEQ ID NO: 18315 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tattttaaaattaccatcaa

SEQ ID NO: 18316 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aaatgtaaattataaaaaat

SEQ ID NO: 18317 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ccaccttacagatgaggtaa

SEQ ID NO: 18318 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tggctggcatattgaggatt

SEQ ID NO: 18319 - DNA, 20 bp, Artificial Sequence
  Description of Artificial Sequence: Synthetic oligonucleotide
  Target: ATXN1; (-) strand; PAM type: NNGRRT; PAM sequence: GAGGAT
taatggctggctggcatatt

SEQ ID NO: 18320 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tgcgatcagaaacacaagga

SEQ ID NO: 18321 - DNA, 20 bp, Artificial Sequence
  Description of Artificial Sequence: Synthetic oligonucleotide
  Target: ATXN1; (-) strand; PAM type: NNGRRT; PAM sequence: CGGAGT
gggcatcttctagtgacaca

SEQ ID NO: 18322 - DNA, 20 bp, Artificial Sequence
  Description of Artificial Sequence: Synthetic oligonucleotide
  Target: ATXN1; (-) strand; PAM type: NNGRRT; PAM sequence: CTGGAT
aggcttccctgaaagggttc

SEQ ID NO: 18323 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tattaatgaggcttccctga

SEQ ID NO: 18324 - DNA, 20 bp, Artificial Sequence
  Description of Artificial Sequence: Synthetic oligonucleotide
  Target: ATXN1; (-) strand; PAM type: NNGRRT; PAM sequence: CAGAAT
attttgtctgtaccccgaga

SEQ ID NO: 18325 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cttcatactttaaattactg

SEQ ID NO: 18326 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aactctgagtacacctacag

SEQ ID NO: 18327 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cttaatgtattttgtgaact

SEQ ID NO: 18328 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aaccttttaaaaagagttaa

SEQ ID NO: 18329 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gctcactgcaaccttttaaa

SEQ ID NO: 18330 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcgcactgttgcctgggc

SEQ ID NO: 18331 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttttttttcttttttgaga

SEQ ID NO: 18332 - DNA, 20 bp, Artificial Sequence
  Description of Artificial Sequence: Synthetic oligonucleotide
  Target: ATXN1; (-) strand; PAM type: NNGRRT; PAM sequence: CGGAAT
gctagcagggaaaaataatg

SEQ ID NO: 18333 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttttctcagcctactatatg

SEQ ID NO: 18334 - DNA, 20 bp, Artificial Sequence
  Description of Artificial Sequence: Synthetic oligonucleotide
  Target: ATXN1; (-) strand; PAM type: NNGRRT; PAM sequence: AAGGGT
attcatgaaatttaaatcag

SEQ ID NO: 18335 - DNA, 20 bp, Artificial Sequence
  Description of Artificial Sequence: Synthetic oligonucleotide
  Target: ATXN1; (-) strand; PAM type: NNGRRT; PAM sequence: TTGAGT
cagctataatcaataacagt

SEQ ID NO: 18336 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gtgaattctggagtttagcc

SEQ ID NO: 18337 - DNA, 20 bp, Artificial Sequence
  Description of Artificial Sequence: Synthetic oligonucleotide
  Target: ATXN1; (-) strand; PAM type: NNGRRT; PAM sequence: TGGAGT
attaatgtatcagtgaattc

SEQ ID NO: 18338 - DNA, 20 bp, Artificial Sequence
  Description of Artificial Sequence: Synthetic oligonucleotide
  Target: ATXN1; (-) strand; PAM type: NNGRRT; PAM sequence: GTGAAT
atttcattattaatgtatca

SEQ ID NO: 18339 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ttaagtgaaattaaggagag

SEQ ID NO: 18340 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttggatttccctttgttctt

SEQ ID NO: 18341 - DNA, 20 bp, Artificial Sequence
  Description of Artificial Sequence: Synthetic oligonucleotide
  Target: ATXN1; (-) strand; PAM type: NNGRRT; PAM sequence: TTGGAT
acaggaatttaatccttcaa

SEQ ID NO: 18342 - DNA, 20 bp, Artificial Sequence
  Description of Artificial Sequence: Synthetic oligonucleotide
  Target: ATXN1; (-) strand; PAM type: NNGRRT; PAM sequence: AGGAAT
catgagtgactggttttgac

SEQ ID NO: 18343 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tgcgatatacgtgcagacac

SEQ ID NO: 18344 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ctggaaaggggatttatacc

SEQ ID NO: 18345 - DNA, 20 bp, Artificial Sequence
  Description of Artificial Sequence: Synthetic oligonucleotide
  Target: ATXN1; (-) strand; PAM type: NNGRRT; PAM sequence: GGGGAT
gaatttctgctctctggaaa

SEQ ID NO: 18346 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agtttgaagtgtggcagatt

SEQ ID NO: 18347 - DNA, 20 bp, Artificial Sequence
  Description of Artificial Sequence: Synthetic oligonucleotide
  Target: ATXN1; (-) strand; PAM type: NNGRRT; PAM sequence: ATGAAT
cgtatgtacccgaaatgctg

SEQ ID NO: 18348 - DNA, 20 bp, Artificial Sequence
  Description of Artificial Sequence: Synthetic oligonucleotide
  Target: ATXN1; (-) strand; PAM type: NNGRRT; PAM sequence: GAGAGT
agctttgctctcttttgtgt

SEQ ID NO: 18349 - DNA, 20 bp, Artificial Sequence
  Description of Artificial Sequence: Synthetic oligonucleotide
  Target: ATXN1; (-) strand; PAM type: NNGRRT; PAM sequence: ATGGGT
aacacagaagttaatcacaa

SEQ ID NO: 18350 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ttctttctgtgttctttgct

SEQ ID NO: 18351 - DNA, 20 bp, Artificial Sequence
  Description of Artificial Sequence: Synthetic oligonucleotide
  Target: ATXN1; (-) strand; PAM type: NNGRRT; PAM sequence: TTGGAT
catcacttactaaagttccc

SEQ ID NO: 18352 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tcctgaccaacttcttgcat

SEQ ID NO: 18353 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gttattctgaatattatggc

SEQ ID NO: 18354 - DNA, 20 bp, Artificial Sequence
  Description of Artificial Sequence: Synthetic oligonucleotide
  Target: ATXN1; (-) strand; PAM type: NNGRRT; PAM sequence: CTGAAT
taaaattctagtgtgttatt

SEQ ID NO: 18355 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ttctctttctacttctcttc

SEQ ID NO: 18356 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gtttataactaatttgctac

SEQ ID NO: 18357 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tctgctttcaaaattcttaa

SEQ ID NO: 18358 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gatcaagagaaagcttctcg

SEQ ID NO: 18359 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtacattaaggacttaaata

SEQ ID NO: 18360 - DNA, 20 bp, Artificial Sequence
  Description of Artificial Sequence: Synthetic oligonucleotide
  Target: ATXN1; (-) strand; PAM type: NNGRRT; PAM sequence: CTGGAT
agatcattctggcattggtc

SEQ ID NO: 18361 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cggtttaaggaactgagctt

SEQ ID NO: 18362 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aaatatggatgtgcccttct

SEQ ID NO: 18363 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttccataattacccacaaat

SEQ ID NO: 18364 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cttctcctcatgatggctcc

SEQ ID NO: 18365 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttgcataatagaggaggaat

SEQ ID NO: 18366 - DNA, 20 bp, Artificial Sequence
  Description of Artificial Sequence: Synthetic oligonucleotide
  Target: ATXN1; (-) strand; PAM type: NNGRRT; PAM sequence: AGGAAT
acctatttgcataatagagg

SEQ ID NO: 18367 - DNA, 20 bp, Artificial Sequence
  Description of Artificial Sequence: Synthetic oligonucleotide
  Target: ATXN1; (-) strand; PAM type: NNGRRT; PAM sequence: ACGGGT
gttgttttatggacaaagac

SEQ ID NO: 18368 - DNA, 20 bp, Artificial Sequence
  Description of Artificial Sequence: Synthetic oligonucleotide
  Target: ATXN1; (-) strand; PAM type: NNGRRT; PAM sequence: TAGGGT
attcatgtttacatatctta

SEQ ID NO: 18369 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tttctttcacttaaagaaaa

SEQ ID NO: 18370 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttgaatagctttcatttaac

SEQ ID NO: 18371 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gatacagcaattgattcaag

SEQ ID NO: 18372 - DNA, 20 bp, Artificial Sequence
  Description of Artificial Sequence: Synthetic oligonucleotide
  Target: ATXN1; (-) strand; PAM type: NNGRRT; PAM sequence: ATGGAT
aatctgctgtgtattggaga

SEQ ID NO: 18373 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tataaatctgctgtgtattg

SEQ ID NO: 18374 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ggaatgttatgtaggacaaa

SEQ ID NO: 18375 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ctcgttgggagttcagccca

SEQ ID NO: 18376 - DNA, 20 bp, Artificial Sequence
  Description of Artificial Sequence: Synthetic oligonucleotide
  Target: ATXN1; (-) strand; PAM type: NNGRRT; PAM sequence: GGGAGT
acaaatatatgcccctcgtt

SEQ ID NO: 18377 - DNA, 20 bp, Artificial Sequence
  Description of Artificial Sequence: Synthetic oligonucleotide
  Target: ATXN1; (-) strand; PAM type: NNGRRT; PAM sequence: AAGGGT
atattaatgttttgtcagga

SEQ ID NO: 18378 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gtggtacagaataaaaatgt

SEQ ID NO: 18379 - DNA, 20 bp, Artificial Sequence
  Description of Artificial Sequence: Synthetic oligonucleotide
  Target: ATXN1; (-) strand; PAM type: NNGRRT; PAM sequence: CAGAAT
atgggtgcttcaaggtggta

SEQ ID NO: 18380 - DNA, 20 bp, Artificial Sequence
  Description of Artificial Sequence: Synthetic oligonucleotide
  Target: ATXN1; (-) strand; PAM type: NNGRRT; PAM sequence: ATGGGT
agggcttattttaaaaagtt

SEQ ID NO: 18381 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ggattggaagaattttctcc

SEQ ID NO: 18382 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgtgtggattgttggattgg

SEQ ID NO: 18383 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gtgtaggaatgtgtggattg

SEQ ID NO: 18384 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ttggttttgtgtaggaatgt

SEQ ID NO: 18385 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tcaagtgattggttttgtgt

SEQ ID NO: 18386 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gacctggagtagaggcagtg

SEQ ID NO: 18387 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ggcatagtcctgggatgacc

SEQ ID NO: 18388 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ttagctcacaggcatagtcc

SEQ ID NO: 18389 - DNA, 20 bp, Artificial Sequence
  Description of Artificial Sequence: Synthetic oligonucleotide
  Target: ATXN1; (-) strand; PAM type: NNGRRT; PAM sequence: GGGAGT
aactccctcttgagctcttg

SEQ ID NO: 18390 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tcctcttggacgacatccct

SEQ ID NO: 18391 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ttttattctgggccacccta

SEQ ID NO: 18392 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgcttggtgatggagtagct

SEQ ID NO: 18393 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cagggacttttgcttggtga

SEQ ID NO: 18394 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ctctttacagcttttccccc

SEQ ID NO: 18395 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttgttagttgcagaaatact

SEQ ID NO: 18396 - DNA, 20 bp, Artificial Sequence
  Description of Artificial Sequence: Synthetic oligonucleotide
  Target: ATXN1; (-) strand; PAM type: NNGRRT; PAM sequence: ATGAGT
catttgtatctgcaaaaacc

SEQ ID NO: 18397 - DNA, 20 bp, Artificial Sequence
  Description of Artificial Sequence: Synthetic oligonucleotide
  Target: ATXN1; (-) strand; PAM type: NNGRRT; PAM sequence: GTGAAT
agaagctcttccagccacct

SEQ ID NO: 18398 - DNA, 20 bp, Artificial Sequence
  Description of Artificial Sequence: Synthetic oligonucleotide
  Target: ATXN1; (-) strand; PAM type: NNGRRT; PAM sequence: GTGGAT
atctgctctgagaagtcctt

SEQ ID NO: 18399 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aatcaaattgatctcatata

SEQ ID NO: 18400 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ctaaacttgatggataaaca

SEQ ID NO: 18401 - DNA, 20 bp, Artificial Sequence
  Description of Artificial Sequence: Synthetic oligonucleotide
  Target: ATXN1; (-) strand; PAM type: NNGRRT; PAM sequence: ATGGAT
agtgccggagcctaaacttg

SEQ ID NO: 18402 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttcaagaccagcctgggcca

SEQ ID NO: 18403 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cggtgggatcgcctgaggct

SEQ ID NO: 18404 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gctttgggaggccaaggcgg

SEQ ID NO: 18405 - DNA, 20 bp, Artificial Sequence
  Description of Artificial Sequence: Synthetic oligonucleotide
  Target: ATXN1; (-) strand; PAM type: NNGRRT; PAM sequence: TCGAAT
tgggcatggtggctcatgcc

SEQ ID NO: 18406 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aaatgcaagagtccaatccc

SEQ ID NO: 18407 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ctggaatggtgaagaaatgc

SEQ ID NO: 18408 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gaacaatattgagatggagc

SEQ ID NO: 18409 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aaagacatgtctttgcttaa

SEQ ID NO: 18410 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tatttgcgtttccgaagttg

SEQ ID NO: 18411 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tggatagtcataatgactgc

SEQ ID NO: 18412 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gccttagataaattgtttca

SEQ ID NO: 18413 - DNA, 20 bp, Artificial Sequence
  Description of Artificial Sequence: Synthetic oligonucleotide
  Target: ATXN1; (-) strand; PAM type: NNGRRT; PAM sequence: CAGAGT
taatagcacatcacagaatt

SEQ ID NO: 18414 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cagctgataatagcacatca

SEQ ID NO: 18415 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tgtgcagtggttaatgtgtc

SEQ ID NO: 18416 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttaaatgtccagggtcttca

SEQ ID NO: 18417 - DNA, 20 bp, Artificial Sequence
  Description of Artificial Sequence: Synthetic oligonucleotide
  Target: ATXN1; (-) strand; PAM type: NNGRRT; PAM sequence: CAGGGT
actttctcattttaaatgtc

SEQ ID NO: 18418 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tcgcaaagtttctgtctctg

SEQ ID NO: 18419 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tcatctttaagtcctggagg

SEQ ID NO: 18420 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tctgagtaggaccttgaaat

SEQ ID NO: 18421 - DNA, 20 bp, Artificial Sequence
  Description of Artificial Sequence: Synthetic oligonucleotide
  Target: ATXN1; (-) strand; PAM type: NNGRRT; PAM sequence: CTGAGT
taaaatgaagaaacgtcttt

SEQ ID NO: 18422 - DNA, 20 bp, Artificial Sequence
  Description of Artificial Sequence: Synthetic oligonucleotide
  Target: ATXN1; (-) strand; PAM type: NNGRRT; PAM sequence: GTGAGT
atcctagtgattagcagaat

SEQ ID NO: 18423 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tcagtcatcctagtgattag

SEQ ID NO: 18424 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ccatacaactttgctttcta

SEQ ID NO: 18425 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gcagttttgtttggtttgat

SEQ ID NO: 18426 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cttcatctaaggaagtggga

SEQ ID NO: 18427 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cagttcacctctggagctgc

SEQ ID NO: 18428 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggaggcagaaatgactctgg

SEQ ID NO: 18429 - DNA, 20 bp, Artificial Sequence
  Description of Artificial Sequence: Synthetic oligonucleotide
  Target: ATXN1; (-) strand; PAM type: NNGRRT; PAM sequence: CTGGAT
aaggggaggcagaaatgact

SEQ ID NO: 18430 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ccgctgcagcacccccagag

SEQ ID NO: 18431 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcccattggaaactgaagcc

SEQ ID NO: 18432 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ggacgccttctccaggtgga

SEQ ID NO: 18433 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cgggtgaccatccatctcct

SEQ ID NO: 18434 - DNA, 20 bp, Artificial Sequence
  Description of Artificial Sequence: Synthetic oligonucleotide
  Target: ATXN1; (-) strand; PAM type: NNGRRT; PAM sequence: CCGGGT
tgcccttttgagttggccgg

SEQ ID NO: 18435 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ctaatcttatctgtgccctt

SEQ ID NO: 18436 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ctcgtcaagtatgaaaccgg

SEQ ID NO: 18437 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aggagaactgcttaaagggg

SEQ ID NO: 18438 - DNA, 20 bp, Artificial Sequence
  Description of Artificial Sequence: Synthetic oligonucleotide
  Target: ATXN1; (-) strand; PAM type: NNGRRT; PAM sequence: AGGGGT
tggaaaggagaactgcttaa

SEQ ID NO: 18439 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ggagatacttttatctggaa

SEQ ID NO: 18440 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ctattgcatcgaatgaataa

SEQ ID NO: 18441 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaatgcagctattgcatcga

SEQ ID NO: 18442 - DNA, 20 bp, Artificial Sequence
  Description of Artificial Sequence: Synthetic oligonucleotide
  Target: ATXN1; (-) strand; PAM type: NNGRRT; PAM sequence: TCGAAT
ttagaaatgcagctattgca

SEQ ID NO: 18443 - DNA, 20 bp, Artificial Sequence
  Description of Artificial Sequence: Synthetic oligonucleotide
  Target: ATXN1; (-) strand; PAM type: NNGRRT; PAM sequence: CTGAAT
cctcattgaaaaaattccta

SEQ ID NO: 18444 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aagctgtacgtaatagagtg

SEQ ID NO: 18445 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ggaaagaaagctgtacgtaa

SEQ ID NO: 18446 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggagaaagaaaggtccaatg

SEQ ID NO: 18447 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgtgctttgtccatcacaca

SEQ ID NO: 18448 - DNA, 20 bp, Artificial Sequence
  Description of Artificial Sequence: Synthetic oligonucleotide
  Target: ATXN1; (-) strand; PAM type: NNGRRT; PAM sequence: TGGGGT
attgtggtcaggaaccagca

SEQ ID NO: 18449 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tgtgatgcttatgttacaaa

SEQ ID NO: 18450 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tttccagtatgtggcatcta

SEQ ID NO: 18451 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tatgttatttgctacctttt

SEQ ID NO: 18452 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tcattcttgaaatctcagct

SEQ ID NO: 18453 - DNA, 20 bp, Artificial Sequence
  Description of Artificial Sequence: Synthetic oligonucleotide
  Target: ATXN1; (-) strand; PAM type: NNGRRT; PAM sequence: TAGAAT
atggtcctcaggataaagtc

SEQ ID NO: 18454 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ccctgggttctcatggtcct

SEQ ID NO: 18455 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgtttttcttaactccctcc

SEQ ID NO: 18456 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gctgagtggctctgctgagc

SEQ ID NO: 18457 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tctcaaagtgtgagttttag

SEQ ID NO: 18458 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aggaaggctggtctcaaagt

SEQ ID NO: 18459 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgggaacaacttcctaggga

SEQ ID NO: 18460 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aaggttgggaacaacttcct

SEQ ID NO: 18461 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tcctgttgtagctcttctcc

SEQ ID NO: 18462 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cgtagcaggctgccctgcta

SEQ ID NO: 18463 - DNA, 20 bp, Artificial Sequence
  Description of Artificial Sequence: Synthetic oligonucleotide
  Target: ATXN1; (-) strand; PAM type: NNGRRT; PAM sequence: CGGGGT
attatccaagtctctggggt

SEQ ID NO: 18464 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ctaaccattatccaagtctc

SEQ ID NO: 18465 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agggcctagagagatcagtc

SEQ ID NO: 18466 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ggagccctgtcctgggagca

SEQ ID NO: 18467 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gtccactggatggctttgct

SEQ ID NO: 18468 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ccaggctggcgagtggtcca

SEQ ID NO: 18469 - DNA, 20 bp, Artificial Sequence
  Description of Artificial Sequence: Synthetic oligonucleotide
  Target: ATXN1; (-) strand; PAM type: NNGRRT; PAM sequence: GCGAGT
tcaaattctgcaccaggctg

SEQ ID NO: 18470 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gtacccagggccaacctggc

SEQ ID NO: 18471 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tacattgttactaatgatat

SEQ ID NO: 18472 - DNA, 20 bp, Artificial Sequence
  Description of Artificial Sequence: Synthetic oligonucleotide
  Target: ATXN1; (-) strand; PAM type: NNGRRT; PAM sequence: CTGAAT
taagttagagggagcttgct

SEQ ID NO: 18473 - DNA, 20 bp, Artificial Sequence
  Description of Artificial Sequence: Synthetic oligonucleotide
  Target: ATXN1; (-) strand; PAM type: NNGRRT; PAM sequence: GCGAAT
tttactgttgtaaagccgca

SEQ ID NO: 18474 - DNA, 20 bp, Artificial Sequence
  Description of Artificial Sequence: Synthetic oligonucleotide
  Target: ATXN1; (-) strand; PAM type: NNGRRT; PAM sequence: TCGAGT
ttcctatcatttttggacat

SEQ ID NO: 18475 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gctatacagttctcatttgc

SEQ ID NO: 18476 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ggtagctctgctctacagaa

SEQ ID NO: 18477 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ccagttttagtaggcagagt

SEQ ID NO: 18478 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gagcagccagttttagtagg

SEQ ID NO: 18479 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tgctgcatttgaggtatagt

SEQ ID NO: 18480 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gaaggcatagcatttaagag

SEQ ID NO: 18481 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgataatatcacctaactca

SEQ ID NO: 18482 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aatttcctcatctgttgaat

SEQ ID NO: 18483 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atcctcaatttcctcatctg

SEQ ID NO: 18484 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aaagtcagggagattgaggc

SEQ ID NO: 18485 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ttgtttcatagacagagagg

SEQ ID NO: 18486 - DNA, 20 bp, Artificial Sequence
  Description of Artificial Sequence: Synthetic oligonucleotide
  Target: ATXN1; (-) strand; PAM type: NNGRRT; PAM sequence: GAGGGT
atagaaaaggtgacatttga

SEQ ID NO: 18487 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gtgggattattttttgcaag

SEQ ID NO: 18488 - DNA, 20 bp, Artificial Sequence
  Description of Artificial Sequence: Synthetic oligonucleotide
  Target: ATXN1; (-) strand; PAM type: NNGRRT; PAM sequence: TGGGAT
aagaatctttcagctgattg

SEQ ID NO: 18489 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tggaatgcagtataactgga

SEQ ID NO: 18490 - DNA, 20 bp, Artificial Sequence
  Description of Artificial Sequence: Synthetic oligonucleotide
  Target: ATXN1; (-) strand; PAM type: NNGRRT; PAM sequence: TGGAAT
acaacatccatttctggagg

SEQ ID NO: 18491 - DNA, 20 bp, Artificial Sequence
  Description of Artificial Sequence: Synthetic oligonucleotide
  Target: ATXN1; (-) strand; PAM type: NNGRRT; PAM sequence: CTGAAT
catctatattagtttcatac

SEQ ID NO: 18492 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tattattatgtcattattta

SEQ ID NO: 18493 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tgttagattttgtatttaat

SEQ ID NO: 18494 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ctctgacattgtacagttcc

SEQ ID NO: 18495 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gtgctactcactgtaccttg

SEQ ID NO: 18496 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttctgttgcctgccctgcaa

SEQ ID NO: 18497 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gtcttccaggaccctacaga

SEQ ID NO: 18498 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agtagtcttccaggacccta

SEQ ID NO: 18499 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttgaaaatatggtttcaaa

SEQ ID NO: 18500 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aaaaaggaatttaatatgta

SEQ ID NO: 18501 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gcattagaaaattattaaaa

SEQ ID NO: 18502 - DNA, 20 bp, Artificial Sequence
  Description of Artificial Sequence: Synthetic oligonucleotide
  Target: ATXN1; (-) strand; PAM type: NNGRRT; PAM sequence: TCGAGT
aggcctgggggatatgtttt

SEQ ID NO: 18503 - DNA, 20 bp, Artificial Sequence
  Description of Artificial Sequence: Synthetic oligonucleotide
  Target: ATXN1; (-) strand; PAM type: NNGRRT; PAM sequence: GGGGAT
gaaactccactgtaggcctg

SEQ ID NO: 18504 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tgggcttgttgagcagagcg

SEQ ID NO: 18505 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aattccctctttattttctg

SEQ ID NO: 18506 - DNA, 20 bp, Artificial Sequence
  Description of Artificial Sequence: Synthetic oligonucleotide
  Target: ATXN1; (-) strand; PAM type: NNGRRT; PAM sequence: GAGGAT
agacccacggaaatcgagaa

SEQ ID NO: 18507 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gccagattgtctttcttaca

SEQ ID NO: 18508 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ctccttcactagaacagtga

SEQ ID NO: 18509 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ttctctccttcactagaaca

SEQ ID NO: 18510 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aaaggaggtcacgctttagt

SEQ ID NO: 18511 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tggcgctgaacgcaagctct

SEQ ID NO: 18512 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgactcttaaaagaacttca

SEQ ID NO: 18513 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tccaaatgttattcagcatc

SEQ ID NO: 18514 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tttcaggggattggcttaag

SEQ ID NO: 18515 - DNA, 20 bp, Artificial Sequence
  Description of Artificial Sequence: Synthetic oligonucleotide
  Target: ATXN1; (-) strand; PAM type: NNGRRT; PAM sequence: GGGGAT
caatttgcttatccgtttca

SEQ ID NO: 18516 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ctaggaagtcaggatcaagg

SEQ ID NO: 18517 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ggtaacacagtctaggaagt

SEQ ID NO: 18518 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gcataaggcaaggcatggct

SEQ ID NO: 18519 - DNA, 20 bp, Artificial Sequence
  Description of Artificial Sequence: Synthetic oligonucleotide
  Target: ATXN1; (-) strand; PAM type: NNGRRT; PAM sequence: TCGAGT
tgtccttaagaagcttacag

SEQ ID NO: 18520 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gttaagtgatagaatcgtgc

SEQ ID NO: 18521 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gtttcccagctgttaagtga

SEQ ID NO: 18522 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gaaactgtggcacagagagg

SEQ ID NO: 18523 - DNA, 20 bp, Artificial Sequence
  Description of Artificial Sequence: Synthetic oligonucleotide
  Target: ATXN1; (-) strand; PAM type: NNGRRT; PAM sequence: GAGGGT
cgaggaaactgtggcacaga

SEQ ID NO: 18524 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ctattctgcatattaactta

SEQ ID NO: 18525 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tatgccaacaaggccctcta

SEQ ID NO: 18526 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aaggttaagacaggaacaag

SEQ ID NO: 18527 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ctgtgtagcccaaaagggct

SEQ ID NO: 18528 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ttttttggtgctgagttagt

SEQ ID NO: 18529 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tgtggtttttttttttggtg

SEQ ID NO: 18530 - DNA, 20 bp, Artificial Sequence
  Description of Artificial Sequence: Synthetic oligonucleotide
  Target: ATXN1; (-) strand; PAM type: NNGRRT; PAM sequence: GAGGAT
aatgtaatgagagaaaattt

SEQ ID NO: 18531 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agatatagaattggtgaatc

SEQ ID NO: 18532 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aataaagagatatagaattg

SEQ ID NO: 18533 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttatagaaaataaagagata

SEQ ID NO: 18534 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gggtgtgttttgtaacttta

SEQ ID NO: 18535 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctttgataaaccacattaat

SEQ ID NO: 18536 - DNA, 20 bp, Artificial Sequence
  Description of Artificial Sequence: Synthetic oligonucleotide
  Target: ATXN1; (-) strand; PAM type: NNGRRT; PAM sequence: ATGAAT
taatgtgtgtgtgtataaaa

SEQ ID NO: 18537 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aggctgggtggctggaggag

SEQ ID NO: 18538 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gaaggaggctgggtggctgg

SEQ ID NO: 18539 - DNA, 20 bp, Artificial Sequence
  Description of Artificial Sequence: Synthetic oligonucleotide
  Target: ATXN1; (-) strand; PAM type: NNGRRT; PAM sequence: CTGGGT
atgatctggggtgaaggagg

SEQ ID NO: 18540 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tctgccttcttttcatgatc

SEQ ID NO: 18541 - DNA, 20 bp, Artificial Sequence
  Description of Artificial Sequence: Synthetic oligonucleotide
  Target: ATXN1; (-) strand; PAM type: NNGRRT; PAM sequence: GAGAGT
agagaaggtaagaggcagcg

SEQ ID NO: 18542 - DNA, 20 bp, Artificial Sequence
  Description of Artificial Sequence: Synthetic oligonucleotide
  Target: ATXN1; (-) strand; PAM type: NNGRRT; PAM sequence: TAGAAT
agggatgacgtcagctggtg

SEQ ID NO: 18543 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ggagggggatgactgaattc

SEQ ID NO: 18544 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gacacccaggagggggatga

SEQ ID NO: 18545 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aaaagtttgacacccaggag

SEQ ID NO: 18546 - DNA, 20 bp, Artificial Sequence
  Description of Artificial Sequence: Synthetic oligonucleotide
  Target: ATXN1; (-) strand; PAM type: NNGRRT; PAM sequence: TTGGGT
cataaaagtgatctttgaaa

SEQ ID NO: 18547 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aagtctgaagataaatttgg

SEQ ID NO: 18548 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gagcagacagtagagagtat

SEQ ID NO: 18549 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ctggattcgagcagacagta

SEQ ID NO: 18550 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gctggtggacatctgaattt

SEQ ID NO: 18551 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gcctaggtgctggtggacat

SEQ ID NO: 18552 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttgcatttctgtgggaagag

SEQ ID NO: 18553 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ctttgaggaggagggatcac

SEQ ID NO: 18554 - DNA, 20 bp, Artificial Sequence
  Description of Artificial Sequence: Synthetic oligonucleotide
  Target: ATXN1; (-) strand; PAM type: NNGRRT; PAM sequence: AGGGAT
caggaaagactttgaggagg

SEQ ID NO: 18555 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tcagaagagtgacgctgagt

SEQ ID NO: 18556 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aggaattcagaagagtgacg

SEQ ID NO: 18557 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ctaacagtgaaggaattcag

SEQ ID NO: 18558 - DNA, 20 bp, Artificial Sequence
  Description of Artificial Sequence: Synthetic oligonucleotide
  Target: ATXN1; (-) strand; PAM type: NNGRRT; PAM sequence: AGGAAT
taacagtgttctaacagtga

SEQ ID NO: 18559 - DNA, 20 bp, Artificial Sequence
  Description of Artificial Sequence: Synthetic oligonucleotide
  Target: ATXN1; (-) strand; PAM type: NNGRRT; PAM sequence: TGGGGT
aataatgaatacgaatagaa

SEQ ID NO: 18560 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tctgaaataatgaatacgaa

SEQ ID NO: 18561 - DNA, 20 bp, Artificial Sequence
  Description of Artificial Sequence: Synthetic oligonucleotide
  Target: ATXN1; (-) strand; PAM type: NNGRRT; PAM sequence: ACGAAT
aactctctgaaataatgaat

SEQ ID NO: 18562 - DNA, 20 bp, Artificial Sequence
  Description of Artificial Sequence: Synthetic oligonucleotide
  Target: ATXN1; (-) strand; PAM type: NNGRRT; PAM sequence: ATGAAT
agaagaaactctctgaaata

SEQ ID NO: 18563 - DNA, 20 bp, Artificial Sequence
  Description of Artificial Sequence: Synthetic oligonucleotide
  Target: ATXN1; (-) strand; PAM type: NNGRRT; PAM sequence: GTGAAT
atggtgctgtgggaatggaa

SEQ ID NO: 18564 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aaactactgcatggtgctgt

SEQ ID NO: 18565 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gattcattcatttattcatt

SEQ ID NO: 18566 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cgaagtagcgcaaagtcacc

SEQ ID NO: 18567 - DNA, 20 bp, Artificial Sequence
  Description of Artificial Sequence: Synthetic oligonucleotide
  Target: ATXN1; (-) strand; PAM type: NNGRRT; PAM sequence: ATGAAT
taggcaagtttaagtgtctt

SEQ ID NO: 18568 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgtgataacagaaatatctc

SEQ ID NO: 18569 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tttaacctgtggtgttgaaa

SEQ ID NO: 18570 - DNA, 20 bp, Artificial Sequence
  Description of Artificial Sequence: Synthetic oligonucleotide
  Target: ATXN1; (-) strand; PAM type: NNGRRT; PAM sequence: TTGAGT
atagtttaattgcaaatggg

SEQ ID NO: 18571 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gggaaatagtttaattgcaa

SEQ ID NO: 18572 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ttactgctactttatctctt

SEQ ID NO: 18573 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gaggaaagaaaagaaaaagg

SEQ ID NO: 18574 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagcctgggcga

SEQ ID NO: 18575 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cactgaggcaggagaatcgc

SEQ ID NO: 18576 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggacactgaggcag

SEQ ID NO: 18577 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggtgaatcacttgaggtc

SEQ ID NO: 18578 - DNA, 20 bp, Artificial Sequence
  Description of Artificial Sequence: Synthetic oligonucleotide
  Target: ATXN1; (-) strand; PAM type: NNGRRT; PAM sequence: GTGAAT
actttgggaggctgaggtgg

SEQ ID NO: 18579 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagcactttgggaggctgag

SEQ ID NO: 18580 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tgtcagctgaatgaaaaagg

SEQ ID NO: 18581 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttaagatctacaagtgtcag

SEQ ID NO: 18582 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ttccttacattttattggct

SEQ ID NO: 18583 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tactcttgtaaaatatggaa

SEQ ID NO: 18584 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ggggacaaggtggaggaggg

SEQ ID NO: 18585 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gagtaaaaataaacaaaaac

SEQ ID NO: 18586 - DNA, 20 bp, Artificial Sequence
  Description of Artificial Sequence: Synthetic oligonucleotide
  Target: ATXN1; (-) strand; PAM type: NNGRRT; PAM sequence: CTGAGT
taaatgtggttatttgtggt

SEQ ID NO: 18587 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gattgttgtaaaatgaactg

SEQ ID NO: 18588 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tatcacaactctctgactga

SEQ ID NO: 18589 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tttttgctgaattttaaatt

SEQ ID NO: 18590 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gagccttttatttgtttttg

SEQ ID NO: 18591 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aatagtagatatactgtggg

SEQ ID NO: 18592 - DNA, 20 bp, Artificial Sequence
  Description of Artificial Sequence: Synthetic oligonucleotide
  Target: ATXN1; (-) strand; PAM type: NNGRRT; PAM sequence: GTGGGT
agtaaaatagtagatatact

SEQ ID NO: 18593 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gggctgctgtgaggatggac

SEQ ID NO: 18594 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ctttcttatagggctgctgt

SEQ ID NO: 18595 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ctggagctgccactatgacc

SEQ ID NO: 18596 - DNA, 20 bp, Artificial Sequence
  Description of Artificial Sequence: Synthetic oligonucleotide
  Target: ATXN1; (-) strand; PAM type: NNGRRT; PAM sequence: ATGGAT
actcatttttcaagaggtag

SEQ ID NO: 18597 - DNA, 20 bp, Artificial Sequence
  Description of Artificial Sequence: Synthetic oligonucleotide
  Target: ATXN1; (-) strand; PAM type: NNGRRT; PAM sequence: TTGAAT
caaatctcccatttgaaaat

SEQ ID NO: 18598 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctccacaggtttgggaaccc

SEQ ID NO: 18599 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tgaatcagaatgtttcctgc

SEQ ID NO: 18600 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ccaccctagacttgatgaat

SEQ ID NO: 18601 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggagctccaccctagacttg

SEQ ID NO: 18602 - DNA, 20 bp, Artificial Sequence
  Description of Artificial Sequence: Synthetic oligonucleotide
  Target: ATXN1; (-) strand; PAM type: NNGRRT; PAM sequence: TAGAAT
acctggagagcttaaaaaaa

SEQ ID NO: 18603 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tcccaagcctggctaggcaa

SEQ ID NO: 18604 - DNA, 20 bp, Artificial Sequence
  Description of Artificial Sequence: Synthetic oligonucleotide
  Target: ATXN1; (-) strand; PAM type: NNGRRT; PAM sequence: GGGGAT
agattgtgaaatagaaaata

SEQ ID NO: 18605 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gggcttgggaacacaagggt

SEQ ID NO: 18606 - DNA, 20 bp, Artificial Sequence
  Description of Artificial Sequence: Synthetic oligonucleotide
  Target: ATXN1; (-) strand; PAM type: NNGRRT; PAM sequence: AAGGGT
cagtaagggcttgggaacac

SEQ ID NO: 18607 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ctctattgaagaaagggcca

SEQ ID NO: 18608 - DNA, 20 bp, Artificial Sequence
  Description of Artificial Sequence: Synthetic oligonucleotide
  Target: ATXN1; (-) strand; PAM type: NNGRRT; PAM sequence: TAGGGT
cctggagagtcatgcagaca

SEQ ID NO: 18609 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cagtaagtttttctggcctg

SEQ ID NO: 18610 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttgaatttctttgtgtctgt

SEQ ID NO: 18611 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gaaccagtatttgttgaatc

SEQ ID NO: 18612 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tttaggggaaccagtatttg

SEQ ID NO: 18613 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cagttttccttaatacaatt

SEQ ID NO: 18614 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ctcccttactttgttggctg

SEQ ID NO: 18615 - DNA, 20 bp, Artificial Sequence
  Description of Artificial Sequence: Synthetic oligonucleotide
  Target: ATXN1; (-) strand; PAM type: NNGRRT; PAM sequence: GAGGAT
atgctctctgttttccatct

SEQ ID NO: 18616 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aagtgcatcacatgtcaggt

SEQ ID NO: 18617 - DNA, 20 bp, Artificial Sequence
  Description of Artificial Sequence: Synthetic oligonucleotide
  Target: ATXN1; (-) strand; PAM type: NNGRRT; PAM sequence: CAGGGT
agcatcgtgcatcaagtcac

SEQ ID NO: 18618 - DNA, 20 bp, Artificial Sequence
  Description of Artificial Sequence: Synthetic oligonucleotide
  Target: ATXN1; (-) strand; PAM type: NNGRRT; PAM sequence: TTGGAT
agtctattctgtttttcatt

SEQ ID NO: 18619 - DNA, 20 bp, Artificial Sequence
  Description of Artificial Sequence: Synthetic oligonucleotide
  Target: ATXN1; (-) strand; PAM type: NNGRRT; PAM sequence: CCGAAT
aattctcatacaacagaatg

SEQ ID NO: 18620 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tctgtgtaattctcatacaa

SEQ ID NO: 18621 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gacctgccttttgagctggc

SEQ ID NO: 18622 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tggcctccctctgagccttg

SEQ ID NO: 18623 - DNA, 20 bp, Artificial Sequence
  Description of Artificial Sequence: Synthetic oligonucleotide
  Target: ATXN1; (-) strand; PAM type: NNGRRT; PAM sequence: AGGGAT
catcctcttaatttgatgga

SEQ ID NO: 18624 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tggctagaatcattggagaa

SEQ ID NO: 18625 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gtgtttatcagatgattggc

SEQ ID NO: 18626 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aaagtttagtggaaagttta

SEQ ID NO: 18627 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tttttacttaaccatgtgca

SEQ ID NO: 18628 - DNA, 20 bp, Artificial Sequence
  Description of Artificial Sequence: Synthetic oligonucleotide
  Target: ATXN1; (-) strand; PAM type: NNGRRT; PAM sequence: TCGAGT
taaaaaaatacgttagcaga

SEQ ID NO: 18629 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tatttaagaatataatttta

SEQ ID NO: 18630 - DNA, 20 bp, Artificial Sequence
  Description of Artificial Sequence: Synthetic oligonucleotide
  Target: ATXN1; (-) strand; PAM type: NNGRRT; PAM sequence: AAGAAT
attggtaattaccggtattt

SEQ ID NO: 18631 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aatttttttttctgtttaat

SEQ ID NO: 18632 - DNA, 20 bp, Artificial Sequence
  Description of Artificial Sequence: Synthetic oligonucleotide
  Target: ATXN1; (-) strand; PAM type: NNGRRT; PAM sequence: GGGGAT
agtccagcattcactagttt

SEQ ID NO: 18633 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ggagatcatattcatagctc

SEQ ID NO: 18634 - DNA, 20 bp, Artificial Sequence
  Description of Artificial Sequence: Synthetic oligonucleotide
  Target: ATXN1; (-) strand; PAM type: NNGRRT; PAM sequence: ACGGAT
attggctcacttacctgttt

SEQ ID NO: 18635 - DNA, 20 bp, Artificial Sequence
  Description of Artificial Sequence: Synthetic oligonucleotide
  Target: ATXN1; (-) strand; PAM type: NNGRRT; PAM sequence: AAGGAT
agatgtgttgccatgtaccc

SEQ ID NO: 18636 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gtgtatggatgaaaataatc

SEQ ID NO: 18637 - DNA, 20 bp, Artificial Sequence
  Description of Artificial Sequence: Synthetic oligonucleotide
  Target: ATXN1; (-) strand; PAM type: NNGRRT; PAM sequence: ATGGAT
cttaaaaatagtgagtgtgt

SEQ ID NO: 18638 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gggctgtgctcttaaaaata

SEQ ID NO: 18639 - DNA, 20 bp, Artificial Sequence
  Description of Artificial Sequence: Synthetic oligonucleotide
  Target: ATXN1; (-) strand; PAM type: NNGRRT; PAM sequence: ATGGAT
cttaaataaatgcttggtga

SEQ ID NO: 18640 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aatgcttaaataaatgcttg

SEQ ID NO: 18641 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtggggaaaccaaggactac

SEQ ID NO: 18642 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aaagaagtactaagattaaa

SEQ ID NO: 18643 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atggtacctgcacctcattt

SEQ ID NO: 18644 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tctgccaggtgatatgtaaa

SEQ ID NO: 18645 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ataagaaagcatactcatgc

SEQ ID NO: 18646 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tcttgccttcttccctctga

SEQ ID NO: 18647 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ttattttgtaagtttttgca

SEQ ID NO: 18648 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tctgctgggttttaaaaata

SEQ ID NO: 18649 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tattgtattatgttgctctg

SEQ ID NO: 18650 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tttaacatgacaagttttga

SEQ ID NO: 18651 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gccctttaacatgacaagtt

SEQ ID NO: 18652 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aaaattcatggtagtgtact

SEQ ID NO: 18653 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cttttaatgcatcccatttg

SEQ ID NO: 18654 - DNA, 20 bp, Artificial Sequence
  Description of Artificial Sequence: Synthetic oligonucleotide
  Target: ATXN1; (-) strand; PAM type: NNGRRT; PAM sequence: ATGGAT
attcttttataattatattt

SEQ ID NO: 18655 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaaattacagaagtaataaa

SEQ ID NO: 18656 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gatatacagtgtcagtttta

SEQ ID NO: 18657 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agaacttccttttctaagat

SEQ ID NO: 18658 - DNA, 20 bp, Artificial Sequence
  Description of Artificial Sequence: Synthetic oligonucleotide
  Target: ATXN1; (-) strand; PAM type: NNGRRT; PAM sequence: TCGAAT
tttcagagtaattcaatagt

SEQ ID NO: 18659 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctttccttgctctgtatttt

SEQ ID NO: 18660 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tctgaaaataacacatagat

SEQ ID NO: 18661 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gtaagtaggtaaatgtggga

SEQ ID NO: 18662 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tcacgtaagtaggtaaatgt

SEQ ID NO: 18663 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tttacttttttgcacatacc

SEQ ID NO: 18664 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ttttcattctgaaatgtcaa

SEQ ID NO: 18665 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gtccaaggacgcacatttct

SEQ ID NO: 18666 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcctgtttttgttgtcatta

SEQ ID NO: 18667 - DNA, 20 bp, Artificial Sequence
  Description of Artificial Sequence: Synthetic oligonucleotide
  Target: ATXN1; (-) strand; PAM type: NNGRRT; PAM sequence: AGGAGT
catacctaagtcagttgcct

SEQ ID NO: 18668 - DNA, 20 bp, Artificial Sequence
  Description of Artificial Sequence: Synthetic oligonucleotide
  Target: ATXN1; (-) strand; PAM type: NNGRRT; PAM sequence: CTGAAT
acgactagacttcaggactt

SEQ ID NO: 18669 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ccttgcggatttcgttttaa

SEQ ID NO: 18670 - DNA, 20 bp, Artificial Sequence
  Description of Artificial Sequence: Synthetic oligonucleotide
  Target: ATXN1; (-) strand; PAM type: NNGRRT; PAM sequence: GCGGAT
caaaggcaatatttttcctt

SEQ ID NO: 18671 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tacacaatgccttggaggtc

SEQ ID NO: 18672 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gtggtaaatagatgggaagc

SEQ ID NO: 18673 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttatgagtttttaccgtttt

SEQ ID NO: 18674 - DNA, 20 bp, Artificial Sequence
  Description of Artificial Sequence: Synthetic oligonucleotide
  Target: ATXN1; (-) strand; PAM type: NNGRRT; PAM sequence: ATGAGT
actctattcccagggggttt

SEQ ID NO: 18675 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gctactcaactctattccca

SEQ ID NO: 18676 - DNA, 20 bp, Artificial Sequence
  Description of Artificial Sequence: Synthetic oligonucleotide
  Target: ATXN1; (-) strand; PAM type: NNGRRT; PAM sequence: TAGGAT
taaattttttcccccagggc

SEQ ID NO: 18677 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atttgaaagaaaagataatt

SEQ ID NO: 18678 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ggggcagggggcgggcgggg

SEQ ID NO: 18679 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aataaacatgtactttattt

SEQ ID NO: 18680 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gatctttggtagtaagttaa

SEQ ID NO: 18681 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttggatctattggctgtgat

SEQ ID NO: 18682 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tgaatgtattcattcttaat

SEQ ID NO: 18683 - DNA, 20 bp, Artificial Sequence
  Description of Artificial Sequence: Synthetic oligonucleotide
  Target: ATXN1; (-) strand; PAM type: NNGRRT; PAM sequence: CTGAAT
actgacagtaggcagacatt

SEQ ID NO: 18684 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tttctaaagggtttactcag

SEQ ID NO: 18685 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tagcgatggctggatttcta

SEQ ID NO: 18686 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tccattgcccatagcgatgg

SEQ ID NO: 18687 - DNA, 20 bp, Artificial Sequence
  Description of Artificial Sequence: Synthetic oligonucleotide
  Target: ATXN1; (-) strand; PAM type: NNGRRT; PAM sequence: CTGAAT
agtcatttggatgggagaca

SEQ ID NO: 18688 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttgcatcttctttcagtcat

SEQ ID NO: 18689 - DNA, 20 bp, Artificial Sequence
  Description of Artificial Sequence: Synthetic oligonucleotide
  Target: ATXN1; (-) strand; PAM type: NNGRRT; PAM sequence: GTGGGT
agtgttcctcgtccattcag

SEQ ID NO: 18690 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agctccgcaaataaatggac

SEQ ID NO: 18691 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ctgcacaggaactcttggaa

SEQ ID NO: 18692 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttgatacttgagctttttt

SEQ ID NO: 18693 - DNA, 20 bp, Artificial Sequence
  Description of Artificial Sequence: Synthetic oligonucleotide
  Target: ATXN1; (-) strand; PAM type: NNGRRT; PAM sequence: ATGGGT
cccacccttcggtttatttg

SEQ ID NO: 18694 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gttagctgagacatttctgt

SEQ ID NO: 18695 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gttatatattgcacacagca

SEQ ID NO: 18696 - DNA, 20 bp, Artificial Sequence
  Description of Artificial Sequence: Synthetic oligonucleotide
  Target: ATXN1; (-) strand; PAM type: NNGRRT; PAM sequence: GGGAAT
acatcctgtcgtgcatgcac

SEQ ID NO: 18697 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agaagaccctattacaccca

SEQ ID NO: 18698 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tagcttccctgcgagatcca

SEQ ID NO: 18699 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgagaagagggaaattgctg

SEQ ID NO: 18700 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gtatataatcctacagataa

SEQ ID NO: 18701 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aatccgtttctaaggacggc

SEQ ID NO: 18702 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aaccttagtgggggtggaag

SEQ ID NO: 18703 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gattgagcaagaaccttagt

SEQ ID NO: 18704 - DNA, 20 bp, Artificial Sequence
  Description of Artificial Sequence: Synthetic oligonucleotide
  Target: ATXN1; (-) strand; PAM type: NNGRRT; PAM sequence: AGGGAT
cacgtagggggctgactgaa

SEQ ID NO: 18705 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gcgtgagtgtgagtgagtgt

SEQ ID NO: 18706 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ggagcgcggcgtgagtgtga

SEQ ID NO: 18707 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgtcggagcgcggcgtgagt

SEQ ID NO: 18708 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aggcggtgtcggagcgcggc

SEQ ID NO: 18709 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggaggaggcgctgcggggat

SEQ ID NO: 18710 - DNA, 20 bp, Artificial Sequence
  Description of Artificial Sequence: Synthetic oligonucleotide
  Target: ATXN1; (-) strand; PAM type: NNGRRT; PAM sequence: GGGGAT
cgccgcggaggaggcgctgc

SEQ ID NO: 18711 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gctgcgcggctgctgggagg

SEQ ID NO: 18712 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aacggctgcgcggctgctgg

SEQ ID NO: 18713 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ggcaggcgctgccctgagcc

SEQ ID NO: 18714 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gcgggtgcctggagcgcggc

SEQ ID NO: 18715 - DNA, 20 bp, Artificial Sequence
  Description of Artificial Sequence: Synthetic oligonucleotide
  Target: ATXN1; (-) strand; PAM type: NNGRRT; PAM sequence: GCGGGT
cgcgcgggggtagcgggtgt

SEQ ID NO: 18716 - DNA, 20 bp, Artificial Sequence
  Description of Artificial Sequence: Synthetic oligonucleotide
  Target: ATXN1; (-) strand; PAM type: NNGRRT; PAM sequence: GCGGGT
tcggggaccgcgcgggggta

SEQ ID NO: 18717 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ggtggcctcggggaccgcgc

SEQ ID NO: 18718 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gtgccgggcggggggcgcag

SEQ ID NO: 18719 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ggacgggactttgcgcgcgg

SEQ ID NO: 18720 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ccctcggagggccggcctcg

SEQ ID NO: 18721 - DNA, 20 bp, Artificial Sequence
  Description of Artificial Sequence: Synthetic oligonucleotide
  Target: ATXN1; (-) strand; PAM type: NNGRRT; PAM sequence: GGGGGT
cggcctcggcgccctggggc

SEQ ID NO: 18722 - DNA, 20 bp, Artificial Sequence
  Description of Artificial Sequence: Synthetic oligonucleotide
  Target: ATXN1; (-) strand; PAM type: NNGRRT; PAM sequence: GCGGGT
acggagggctggacttctcc

SEQ ID NO: 18723 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ggagagggcggtgagagaga

SEQ ID NO: 18724 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ggaggcggcggctggggttg

SEQ ID NO: 18725 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cgcaggggggaggcggcggc

SEQ ID NO: 18726 - DNA, 20 bp, Artificial Sequence
  Description of Artificial Sequence: Synthetic oligonucleotide
  Target: ATXN1; (-) strand; PAM type: NNGRRT; PAM sequence: CCGGGT
agagccatgtcctcctccct

SEQ ID NO: 18727 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ggcgggggggctgtcagggg

SEQ ID NO: 18728 - DNA, 20 bp, Artificial Sequence
  Description of Artificial Sequence: Synthetic oligonucleotide
  Target: ATXN1; (-) strand; PAM type: NNGRRT; PAM sequence: GGGGAT
caggacctgtttcactgcag

SEQ ID NO: 18729 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ggaggaggaggaggagagag

SEQ ID NO: 18730 - DNA, 20 bp, Artificial Sequence
  Description of Artificial Sequence: Synthetic oligonucleotide
  Target: ATXN1; (-) strand; PAM type: NNGRRT; PAM sequence: TCGGAT
tgccccccacccccatgaag

SEQ ID NO: 18731 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gctcgccgggccgcccgcca

SEQ ID NO: 18732 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tccccgggcggcgcgcagcg

SEQ ID NO: 18733 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gggggagtcccccaggttgc

SEQ ID NO: 18734 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tgaagcctgacagcccttgg

SEQ ID NO: 18735 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggccgacctcccctccccgc

SEQ ID NO: 18736 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gaccaaggacacgtcgggat

SEQ ID NO: 18737 - DNA, 20 bp, Artificial Sequence
  Description of Artificial Sequence: Synthetic oligonucleotide
  Target: ATXN1; (-) strand; PAM type: NNGRRT; PAM sequence: CGGGAT
gcctgggaccaaggacacgt

SEQ ID NO: 18738 - DNA, 20 bp, Artificial Sequence
  Description of Artificial Sequence: Synthetic oligonucleotide
  Target: ATXN1; (-) strand; PAM type: NNGRRT; PAM sequence: CAGAGT
cttaacgtgcagctgatgat

SEQ ID NO: 18739 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aatccccgcggcccccaggc

SEQ ID NO: 18740 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ggggaccccttgaaactttc

SEQ ID NO: 18741 - DNA, 20 bp, Artificial Sequence
  Description of Artificial Sequence: Synthetic oligonucleotide
  Target: ATXN1; (-) strand; PAM type: NNGRRT; PAM sequence: GAGGGT
cgttcgccggcaggaaaggt

SEQ ID NO: 18742 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gtgcgaagagagaaagaggg

SEQ ID NO: 18743 - DNA, 20 bp, Artificial Sequence
  Description of Artificial Sequence: Synthetic oligonucleotide
  Target: ATXN1; (-) strand; PAM type: NNGRRT; PAM sequence: CGGAGT
gtctcctttccaggctagag

SEQ ID NO: 18744 - DNA, 20 bp, Artificial Sequence
  Description of Artificial Sequence: Synthetic oligonucleotide
  Target: ATXN1; (-) strand; PAM type: NNGRRT; PAM sequence: GCGGGT
attagctgcgagaggagtgc

SEQ ID NO: 18745 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gatccgaaattagctgcgag

SEQ ID NO: 18746 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tcggagaccgcactgaaacc

SEQ ID NO: 18747 - DNA, 20 bp, Artificial Sequence
  Description of Artificial Sequence: Synthetic oligonucleotide
  Target: ATXN1; (-) strand; PAM type: NNGRRT; PAM sequence: GGGAGT
aggcggaggggcggggtggt

SEQ ID NO: 18748 - DNA, 20 bp, Artificial Sequence
  Description of Artificial Sequence: Synthetic oligonucleotide
  Target: ATXN1; (-) strand; PAM type: NNGRRT; PAM sequence: CGGGGT
cggcgagacaggcggagggg

SEQ ID NO: 18749 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cccgacacctaccggccttc

SEQ ID NO: 18750 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tcagaaagaaacttacgcga

SEQ ID NO: 18751 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gcacgtaggctcttgcaggc

SEQ ID NO: 18752 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aaaaagttgtagaaatgagt

SEQ ID NO: 18753 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gaaaaaaaaaagttgtagaa

SEQ ID NO: 18754 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ttgggggcgggggtgaggat

SEQ ID NO: 18755 - DNA, 20 bp, Artificial Sequence
  Description of Artificial Sequence: Synthetic oligonucleotide
  Target: ATXN1; (-) strand; PAM type: NNGRRT; PAM sequence: GAGGAT
agggtgttgggggcgggggt

SEQ ID NO: 18756 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ccaagcagggtgttgggggc

SEQ ID NO: 18757 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ctgaagtcgtctttgccaag

SEQ ID NO: 18758 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gaaagctgtctgaaactgaa

SEQ ID NO: 18759 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ctgttataaaaatatttgag

SEQ ID NO: 18760 - DNA, 20 bp, Artificial Sequence
  Description of Artificial Sequence: Synthetic oligonucleotide
  Target: ATXN1; (-) strand; PAM type: NNGRRT; PAM sequence: TGGAAT
acagtttgcagattatgagt

SEQ ID NO: 18761 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gattggacagtttgcagatt

SEQ ID NO: 18762 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tgtctaaaaatagagtggag

SEQ ID NO: 18763 - DNA, 20 bp, Artificial Sequence
  Description of Artificial Sequence: Synthetic oligonucleotide
  Target: ATXN1; (-) strand; PAM type: NNGRRT; PAM sequence: TAGAGT
aaatgtaagatgtctaaaaa

SEQ ID NO: 18764 - DNA, 20 bp, Artificial Sequence
  Description of Artificial Sequence: Synthetic oligonucleotide
  Target: ATXN1; (-) strand; PAM type: NNGRRT; PAM sequence: CTGAAT
attaattgactaactgtaat

SEQ ID NO: 18765 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ttattaattgtttttaccat

SEQ ID NO: 18766 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tcatgagtatggtgtttatg

SEQ ID NO: 18767 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aaaggtaatgagacagtttc

SEQ ID NO: 18768 - DNA, 20 bp, Artificial Sequence
  Description of Artificial Sequence: Synthetic oligonucleotide
  Target: ATXN1; (-) strand; PAM type: NNGRRT; PAM sequence: AAGAAT
acgagaaagtcttgtttcta

SEQ ID NO: 18769 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ggaagctctgccctttttca

SEQ ID NO: 18770 - DNA, 20 bp, Artificial Sequence
  Description of Artificial Sequence: Synthetic oligonucleotide
  Target: ATXN1; (-) strand; PAM type: NNGRRT; PAM sequence: ATGAGT
acaaacataacaccagcctt

SEQ ID NO: 18771 - DNA, 20 bp, Artificial Sequence
  Description of Artificial Sequence: Synthetic oligonucleotide
  Target: ATXN1; (-) strand; PAM type: NNGRRT; PAM sequence: ACGAGT
agcaatctatgacacaggat

SEQ ID NO: 18772 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tatttaagcaatctatgaca

SEQ ID NO: 18773 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ctggcccatttaacaccttc

SEQ ID NO: 18774 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ttgaaaactacactttaagt

SEQ ID NO: 18775 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctggggtagaacccttgact

SEQ ID NO: 18776 - DNA, 20 bp, Artificial Sequence
  Description of Artificial Sequence: Synthetic oligonucleotide
  Target: ATXN1; (-) strand; PAM type: NNGRRT; PAM sequence: TGGGGT
agattctgatttggtatgtc

SEQ ID NO: 18777 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agcaaaaaagaaataaatag

SEQ ID NO: 18778 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tttgaggtccactttctttt

SEQ ID NO: 18779 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tgagtaaagctaaggcatct

SEQ ID NO: 18780 - DNA, 20 bp, Artificial Sequence
  Description of Artificial Sequence: Synthetic oligonucleotide
  Target: ATXN1; (-) strand; PAM type: NNGRRT; PAM sequence: TTGAGT
attctgtgttatctttgttt

SEQ ID NO: 18781 - DNA, 20 bp, Artificial Sequence
  Description of Artificial Sequence: Synthetic oligonucleotide
  Target: ATXN1; (-) strand; PAM type: NNGRRT; PAM sequence: TAGGGT
agataaacaggagctactat

SEQ ID NO: 18782 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tgaaattaagttacctgatg

SEQ ID NO: 18783 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gagaaacccctaaaattatt

SEQ ID NO: 18784 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tttttgaggatgcaatatgg

SEQ ID NO: 18785 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tctgcttcaagggagttttt

SEQ ID NO: 18786 - DNA, 20 bp, Artificial Sequence
  Description of Artificial Sequence: Synthetic oligonucleotide
  Target: ATXN1; (-) strand; PAM type: NNGRRT; PAM sequence: GGGAGT
aagtatgttatctgcttcaa

SEQ ID NO: 18787 - DNA, 20 bp, Artificial Sequence
  Description of Artificial Sequence: Synthetic oligonucleotide
  Target: ATXN1; (-) strand; PAM type: NNGRRT; PAM sequence: TTGGAT
cgatgtggttccataacttt

SEQ ID NO: 18788 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ctgtataatttccctcattt

SEQ ID NO: 18789 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ttaaaactgtaaaaaatgct

SEQ ID NO: 18790 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aatatataaacatattatct

SEQ ID NO: 18791 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agtcttagttattgtagatg

SEQ ID NO: 18792 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggtgctggatcgcatcaact

SEQ ID NO: 18793 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tgctatgattctggcaggtg

SEQ ID NO: 18794 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttataagtcaacttttgctc

SEQ ID NO: 18795 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cattaaaaattcaaactttc

SEQ ID NO: 18796 - DNA, 20 bp, Artificial Sequence
  Description of Artificial Sequence: Synthetic oligonucleotide
  Target: ATXN1; (-) strand; PAM type: NNGRRT; PAM sequence: TAGGAT
agatttttaaatgacatatg

SEQ ID NO: 18797 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tggtctccccagccttattt

SEQ ID NO: 18798 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tgtgtgagtgtttttcactt

SEQ ID NO: 18799 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ctgacctcagagtctattgt

SEQ ID NO: 18800 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tgggtgtggtgagctgacct

SEQ ID NO: 18801 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cagagcccagtgactttagt

SEQ ID NO: 18802 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gattcagaagtatgtctttt

SEQ ID NO: 18803 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tgtcttgctacagtttggtg

SEQ ID NO: 18804 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gttcatgccataggccagac

SEQ ID NO: 18805 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tgcttggacccacacatgtg

SEQ ID NO: 18806 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tagtgacctgtaagagaaca

SEQ ID NO: 18807 - DNA, 20 bp, Artificial Sequence
  Description of Artificial Sequence: Synthetic oligonucleotide
  Target: ATXN1; (+) strand; PAM type: NNGRRT; PAM sequence: GGGGGT
agagaacagggagtcgaact

SEQ ID NO: 18808 - DNA, 20 bp, Artificial Sequence
  Description of Artificial Sequence: Synthetic oligonucleotide
  Target: ATXN1; (+) strand; PAM type: NNGRRT; PAM sequence: GGGAAT
acaggaggctgtttccaggg

SEQ ID NO: 18809 - DNA, 20 bp, Artificial Sequence
  Description of Artificial Sequence: Synthetic oligonucleotide
  Target: ATXN1; (+) strand; PAM type: NNGRRT; PAM sequence: TAGAAT
agttggtgtgcatgttgagg

SEQ ID NO: 18810 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gaggggagcacgttgctgga

SEQ ID NO: 18811 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ctggagagaatggcaccaag

SEQ ID NO: 18812 - DNA, 20 bp, Artificial Sequence
  Description of Artificial Sequence: Synthetic oligonucleotide
  Target: ATXN1; (+) strand; PAM type: NNGRRT; PAM sequence: ATGGGT
atggcaccaagcagggtgtt

SEQ ID NO: 18813 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gcccgtgccctttgggcggg

SEQ ID NO: 18814 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ttggcacttggtagaaatgt

SEQ ID NO: 18815 - DNA, 20 bp, Artificial Sequence
  Description of Artificial Sequence: Synthetic oligonucleotide
  Target: ATXN1; (+) strand; PAM type: NNGRRT; PAM sequence: TGGGGT
acttggtagaaatgtgggga

SEQ ID NO: 18816 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gaaatgtggggatggggtca

SEQ ID NO: 18817 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gtggggatggggtcagaggg

SEQ ID NO: 18818 - DNA, 20 bp, Artificial Sequence
  Description of Artificial Sequence: Synthetic oligonucleotide
  Target: ATXN1; (+) strand; PAM type: NNGRRT; PAM sequence: CTGAGT
agagggtggggtctggtttt

SEQ ID NO: 18819 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ctacagaaagtgctggagct

SEQ ID NO: 18820 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tatcgtcttccagagcctct

SEQ ID NO: 18821 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gagatgtggaaaacactatc

SEQ ID NO: 18822 - DNA, 20 bp, Artificial Sequence
  Description of Artificial Sequence: Synthetic oligonucleotide
  Target: ATXN1; (+) strand; PAM type: NNGRRT; PAM sequence: CCGGGT
agcaggagggcaacattcat

SEQ ID NO: 18823 - DNA, 20 bp, Artificial Sequence
  Description of Artificial Sequence: Synthetic oligonucleotide
  Target: ATXN1; (+) strand; PAM type: NNGRRT; PAM sequence: TCGAGT
gggacaaagcagcgtctggc

SEQ ID NO: 18824 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtcagagcttctggctgctc

SEQ ID NO: 18825 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttctggctgctcctgaatgg

SEQ ID NO: 18826 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gctattatcttaagacttaa

SEQ ID NO: 18827 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttaagacttaatggagttgc

SEQ ID NO: 18828 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ttgctggagtttgtatttcc

SEQ ID NO: 18829 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttgtatttccaggagtcaag

SEQ ID NO: 18830 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aggagtcaagttgaatggtt

SEQ ID NO: 18831 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aggaggacagtgcgggggcc

SEQ ID NO: 18832 - DNA, 20 bp, Artificial Sequence
  Description of Artificial Sequence: Synthetic oligonucleotide
  Target: ATXN1; (+) strand; PAM type: NNGRRT; PAM sequence: CGGAGT
ggggccaagggtggacaggc

SEQ ID NO: 18833 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aattaactggacagatgaac

SEQ ID NO: 18834 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gttgagccaatgtgttttcc

SEQ ID NO: 18835 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tgtcttaatttgaaattcca

SEQ ID NO: 18836 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcccaagaaattagcagg

SEQ ID NO: 18837 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aaaaggcattggtttgagac

SEQ ID NO: 18838 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gccattccctcagtgtgcca

SEQ ID NO: 18839 - DNA, 20 bp, Artificial Sequence
  Description of Artificial Sequence: Synthetic oligonucleotide
  Target: ATXN1; (+) strand; PAM type: NNGRRT; PAM sequence: AAGGGT
accacatggcactactgtat

SEQ ID NO: 18840 - DNA, 20 bp, Artificial Sequence
  Description of Artificial Sequence: Synthetic oligonucleotide
  Target: ATXN1; (+) strand; PAM type: NNGRRT; PAM sequence: ACGGGT
tactgtataagggtcagtta

SEQ ID NO: 18841 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ggaacaatgacattgtcttg

SEQ ID NO: 18842 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gctgacctgcagcagtccac

SEQ ID NO: 18843 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ggccgctaaactttgaagta

SEQ ID NO: 18844 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ggaaaggcaagcaatgaccc

SEQ ID NO: 18845 - DNA, 20 bp, Artificial Sequence
  Description of Artificial Sequence: Synthetic oligonucleotide
  Target: ATXN1; (+) strand; PAM type: NNGRRT; PAM sequence: CAGGGT
cctggagtagagaagatcca

SEQ ID NO: 18846 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tccacagggtgctgctgtgc

SEQ ID NO: 18847 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cagggtgctgctgtgccagg

SEQ ID NO: 18848 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gtgctgctgtgccagggtga

SEQ ID NO: 18849 - DNA, 20 bp, Artificial Sequence
  Description of Artificial Sequence: Synthetic oligonucleotide
  Target: ATXN1; (+) strand; PAM type: NNGRRT; PAM sequence: AAGGGT
acagtgaccgatggcatgag

SEQ ID NO: 18850 - DNA, 20 bp, Artificial Sequence
  Description of Artificial Sequence: Synthetic oligonucleotide
  Target: ATXN1; (+) strand; PAM type: NNGRRT; PAM sequence: TGGGAT
caaccagagctgtcacactc

SEQ ID NO: 18851 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tttcccctactaaatccatt

SEQ ID NO: 18852 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tttttttttttaatttgaga

SEQ ID NO: 18853 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agggtctctgttgcccaggc

SEQ ID NO: 18854 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cccaggctggagtgcagtgg

SEQ ID NO: 18855 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttttgtattttttatagaga

SEQ ID NO: 18856 - DNA, 20 bp, Artificial Sequence
  Description of Artificial Sequence: Synthetic oligonucleotide
  Target: ATXN1; (+) strand; PAM type: NNGRRT; PAM sequence: TAGGAT
cgtcaacctccccaaagtgc

SEQ ID NO: 18857 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gccactgtgcccggcccatt

SEQ ID NO: 18858 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ggtcttccagctgcttgtaa

SEQ ID NO: 18859 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgaagcagagccttcagaaa

SEQ ID NO: 18860 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gtcttgctctgtcacccagg

SEQ ID NO: 18861 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gattctcgtgcctcagcctt

SEQ ID NO: 18862 - DNA, 20 bp, Artificial Sequence
  Description of Artificial Sequence: Synthetic oligonucleotide
  Target: ATXN1; (+) strand; PAM type: NNGRRT; PAM sequence: CGGGAT
gcctcagccttcagagtagc

SEQ ID NO: 18863 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tgtttatgtttttagtagag

SEQ ID NO: 18864 - DNA, 20 bp, Artificial Sequence
  Description of Artificial Sequence: Synthetic oligonucleotide
  Target: ATXN1; (+) strand; PAM type: NNGRRT; PAM sequence: TCGGGT
ctggtctcaaactcctgggc

SEQ ID NO: 18865 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcagcctcccaaagtgc

SEQ ID NO: 18866 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggttcatctctgcctctgat

SEQ ID NO: 18867 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ggggctgggggagcccacac

SEQ ID NO: 18868 - DNA, 20 bp, Artificial Sequence
  Description of Artificial Sequence: Synthetic oligonucleotide
  Target: ATXN1; (+) strand; PAM type: NNGRRT; PAM sequence: CCGGGT
acaccagagtgtcccttgga

SEQ ID NO: 18869 - DNA, 20 bp, Artificial Sequence
  Description of Artificial Sequence: Synthetic oligonucleotide
  Target: ATXN1; (+) strand; PAM type: NNGRRT; PAM sequence: CCGAGT
cagagatgcagactgctttg

SEQ ID NO: 18870 - DNA, 20 bp, Artificial Sequence
  Description of Artificial Sequence: Synthetic oligonucleotide
  Target: ATXN1; (+) strand; PAM type: NNGRRT; PAM sequence: CTGAGT
cctggggcagcccttgtagc

SEQ ID NO: 18871 - DNA, 20 bp, Artificial Sequence
  Description of Artificial Sequence: Synthetic oligonucleotide
  Target: ATXN1; (+) strand; PAM type: NNGRRT; PAM sequence: GAGAGT
cctcaactaaataatcagag

SEQ ID NO: 18872 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tcctccttggctaagtgaaa

SEQ ID NO: 18873 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tgaggctggaaggtcttgag

SEQ ID NO: 18874 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aggtcttgaggtgggttgag

SEQ ID NO: 18875 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gtgggttgaggtgggttgag

SEQ ID NO: 18876 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ggtgggttgaggtgggtgca

SEQ ID NO: 18877 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ggggattccacctggaagct

SEQ ID NO: 18878 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctggaagctatgggttcttg

SEQ ID NO: 18879 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tggtactcttgaggtaaacg

SEQ ID NO: 18880 - DNA, 20 bp, Artificial Sequence
  Description of Artificial Sequence: Synthetic oligonucleotide
  Target: ATXN1; (+) strand; PAM type: NNGRRT; PAM sequence: AGGAGT
catgctgagagacctgctcg

SEQ ID NO: 18881 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tgagagacctgctcgaggag

SEQ ID NO: 18882 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttttttttttgtttttgagg

SEQ ID NO: 18883 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttttgctctgtcgcccaggc

SEQ ID NO: 18884 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcggcctccccaactgt

SEQ ID NO: 18885 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cactgtgcccggtctgctcg

SEQ ID NO: 18886 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tcgctgaatttctaatgagc

SEQ ID NO: 18887 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cagtttagagcaaatctgta

SEQ ID NO: 18888 - DNA, 20 bp, Artificial Sequence
  Description of Artificial Sequence: Synthetic oligonucleotide
  Target: ATXN1; (+) strand; PAM type: NNGRRT; PAM sequence: GGGGGT
cccagggagaactcgtgagc

SEQ ID NO: 18889 - DNA, 20 bp, Artificial Sequence
  Description of Artificial Sequence: Synthetic oligonucleotide
  Target: ATXN1; (+) strand; PAM type: NNGRRT; PAM sequence: AGGAAT
agcgggggtcaataaggagg

SEQ ID NO: 18890 - DNA, 20 bp, Artificial Sequence
  Description of Artificial Sequence: Synthetic oligonucleotide
  Target: ATXN1; (+) strand; PAM type: NNGRRT; PAM sequence: ACGAGT
ggcactgttattttattagt

SEQ ID NO: 18891 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aaaacaattttgttcaaatt

SEQ ID NO: 18892 - DNA, 20 bp, Artificial Sequence
  Description of Artificial Sequence: Synthetic oligonucleotide
  Target: ATXN1; (+) strand; PAM type: NNGRRT; PAM sequence: TCGAGT
ataaaattcaataaacagac

SEQ ID NO: 18893 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gacacaccacgattagaaaa

SEQ ID NO: 18894 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ccacgattagaaaatagaat

SEQ ID NO: 18895 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gcaagtacaatattttacac

SEQ ID NO: 18896 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tattttacactggaattaca

SEQ ID NO: 18897 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tggcctgtgggaggcatatg

SEQ ID NO: 18898 - DNA, 20 bp, Artificial Sequence
  Description of Artificial Sequence: Synthetic oligonucleotide
  Target: ATXN1; (+) strand; PAM type: NNGRRT; PAM sequence: ACGAGT
atattaaaacatccagtagt

SEQ ID NO: 18899 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tcctttcggctgacactaat

SEQ ID NO: 18900 - DNA, 20 bp, Artificial Sequence
  Description of Artificial Sequence: Synthetic oligonucleotide
  Target: ATXN1; (+) strand; PAM type: NNGRRT; PAM sequence: TAGAGT
ggctgacactaatttgggtt

SEQ ID NO: 18901 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aaagggcagtattcacagaa

SEQ ID NO: 18902 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aagttcaaatgcactaacta

SEQ ID NO: 18903 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctcctgggccagaaaactga

SEQ ID NO: 18904 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggacagtatgttatcttggt

SEQ ID NO: 18905 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aaactaaagggaaagaaaac

SEQ ID NO: 18906 - DNA, 20 bp, Artificial Sequence
  Description of Artificial Sequence: Synthetic oligonucleotide
  Target: ATXN1; (+) strand; PAM type: NNGRRT; PAM sequence: TTGAGT
atgtatctgcagtggaagac

SEQ ID NO: 18907 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agaagggaggggacgagatt

SEQ ID NO: 18908 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ggggacgagattctgaattt

SEQ ID NO: 18909 - DNA, 20 bp, Artificial Sequence
  Description of Artificial Sequence: Synthetic oligonucleotide
  Target: ATXN1; (+) strand; PAM type: NNGRRT; PAM sequence: GGGGGT
tgaatttaagaattgtaagt

SEQ ID NO: 18910 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtccggcttgatttttggac

SEQ ID NO: 18911 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tttttttttttgtccccata

SEQ ID NO: 18912 - DNA, 20 bp, Artificial Sequence
  Description of Artificial Sequence: Synthetic oligonucleotide
  Target: ATXN1; (+) strand; PAM type: NNGRRT; PAM sequence: CTGGAT
agtcctgtttgattggtagc

SEQ ID NO: 18913 - DNA, 20 bp, Artificial Sequence
  Description of Artificial Sequence: Synthetic oligonucleotide
  Target: ATXN1; (+) strand; PAM type: NNGRRT; PAM sequence: TTGGGT
cgtgttcaagattatattct

SEQ ID NO: 18914 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aaaagaagttgcaatggctt

SEQ ID NO: 18915 - DNA, 20 bp, Artificial Sequence
  Description of Artificial Sequence: Synthetic oligonucleotide
  Target: ATXN1; (+) strand; PAM type: NNGRRT; PAM sequence: AGGAAT
cagagaagtactttcagcat

SEQ ID NO: 18916 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tgaacagtattctcaaatcg

SEQ ID NO: 18917 - DNA, 20 bp, Artificial Sequence
  Description of Artificial Sequence: Synthetic oligonucleotide
  Target: ATXN1; (+) strand; PAM type: NNGRRT; PAM sequence: CCGAGT
tattctcaaatcgcagaata

SEQ ID NO: 18918 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agagccatatctttcaaaca

SEQ ID NO: 18919 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ccatatctttcaaacactga

SEQ ID NO: 18920 - DNA, 20 bp, Artificial Sequence
  Description of Artificial Sequence: Synthetic oligonucleotide
  Target: ATXN1; (+) strand; PAM type: NNGRRT; PAM sequence: GTGAGT
cattacctgtactcctcaaa

SEQ ID NO: 18921 - DNA, 20 bp, Artificial Sequence
  Description of Artificial Sequence: Synthetic oligonucleotide
  Target: ATXN1; (+) strand; PAM type: NNGRRT; PAM sequence: CGGAGT
tgtaaaagaaatctcagctc

SEQ ID NO: 18922 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gtagaggtgtgcaagttgtt

SEQ ID NO: 18923 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aattctctatttcagaaatt

SEQ ID NO: 18924 - DNA, 20 bp, Artificial Sequence
  Description of Artificial Sequence: Synthetic oligonucleotide
  Target: ATXN1; (+) strand; PAM type: NNGRRT; PAM sequence: CCGAAT
tcacatcaccaccgaagaaa

SEQ ID NO: 18925 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gaagaaaccgaattgggcca

SEQ ID NO: 18926 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ctggtgcaaattgaagtgca

SEQ ID NO: 18927 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cttagtagtcacagatgtta

SEQ ID NO: 18928 - DNA, 20 bp, Artificial Sequence
  Description of Artificial Sequence: Synthetic oligonucleotide
  Target: ATXN1; (+) strand; PAM type: NNGRRT; PAM sequence: AAGAGT
agtaaagatcaaactgtgca

SEQ ID NO: 18929 - DNA, 20 bp, Artificial Sequence
  Description of Artificial Sequence: Synthetic oligonucleotide
  Target: ATXN1; (+) strand; PAM type: NNGRRT; PAM sequence: GTGGAT
aagatcaaactgtgcaaaga

SEQ ID NO: 18930 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgcaatctatgcggtatcta

SEQ ID NO: 18931 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aagaggtgtgaaaggttccg

SEQ ID NO: 18932 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agtccctttaggggagaagg

SEQ ID NO: 18933 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tcacaattccaagttagaaa

SEQ ID NO: 18934 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcaaatcatcccaaactaaa

SEQ ID NO: 18935 - DNA, 20 bp, Artificial Sequence
  Description of Artificial Sequence: Synthetic oligonucleotide
  Target: ATXN1; (+) strand; PAM type: NNGRRT; PAM sequence: GTGAGT
atcatcccaaactaaactgg

SEQ ID NO: 18936 - DNA, 20 bp, Artificial Sequence
  Description of Artificial Sequence: Synthetic oligonucleotide
  Target: ATXN1; (+) strand; PAM type: NNGRRT; PAM sequence: TTGGAT
agtccaaatgaaaattcaat

SEQ ID NO: 18937 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttgtaagctgaacggcaccg

SEQ ID NO: 18938 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tgaagagaaagctgccacaa

SEQ ID NO: 18939 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gccacaagggagtggtgacc

SEQ ID NO: 18940 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tgcagaaaagaccgtggaaa

SEQ ID NO: 18941 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gactccaggctacatggctc

SEQ ID NO: 18942 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ctccagagtgcgtcttagaa

SEQ ID NO: 18943 - DNA, 20 bp, Artificial Sequence
  Description of Artificial Sequence: Synthetic oligonucleotide
  Target: ATXN1; (+) strand; PAM type: NNGRRT; PAM sequence: CCGGGT
gggacactgcggttcctccc

SEQ ID NO: 18944 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ccctccagccctgctctggc

SEQ ID NO: 18945 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaacaaggaaaaagccaaaa

SEQ ID NO: 18946 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgcacatgctaaaaaagcaa

SEQ ID NO: 18947 - DNA, 20 bp, Artificial Sequence
  Description of Artificial Sequence: Synthetic oligonucleotide
  Target: ATXN1; (+) strand; PAM type: NNGRRT; PAM sequence: GTGGAT
cccatcttagtgttggttta

SEQ ID NO: 18948 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aaaaggtggtgtgtgttttt

SEQ ID NO: 18949 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gtgtgtttttctgagtccac

SEQ ID NO: 18950 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ataattgcaagtgccctgag

SEQ ID NO: 18951 - DNA, 20 bp, Artificial Sequence
  Description of Artificial Sequence: Synthetic oligonucleotide
  Target: ATXN1; (+) strand; PAM type: NNGRRT; PAM sequence: AAGAAT
taaataagcagtatgactgc

SEQ ID NO: 18952 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gctctctgcaagcatgctga

SEQ ID NO: 18953 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ctggtgaaccctaaatgtaa

SEQ ID NO: 18954 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gaatactagacagccaaaat

SEQ ID NO: 18955 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gaagaaagtactattttcaa

SEQ ID NO: 18956 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttagttgcagccatccaagt

SEQ ID NO: 18957 - DNA, 20 bp, Artificial Sequence
  Description of Artificial Sequence: Synthetic oligonucleotide
  Target: ATXN1; (+) strand; PAM type: NNGRRT; PAM sequence: TCGGAT
caaaacccacaaatgatatt

SEQ ID NO: 18958 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaatgatatttcggatctct

SEQ ID NO: 18959 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aaaactatgaaatacccttt

SEQ ID NO: 18960 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cattaaatctcgatttgatt

SEQ ID NO: 18961 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ctttatggaaaactctctca

SEQ ID NO: 18962 - DNA, 20 bp, Artificial Sequence
  Description of Artificial Sequence: Synthetic oligonucleotide
  Target: ATXN1; (+) strand; PAM type: NNGRRT; PAM sequence: CAGAGT
atgaatctgaagaaaattct

SEQ ID NO: 18963 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gatgtggtaaaaagaccaaa

SEQ ID NO: 18964 - DNA, 20 bp, Artificial Sequence
  Description of Artificial Sequence: Synthetic oligonucleotide
  Target: ATXN1; (+) strand; PAM type: NNGRRT; PAM sequence: TAGAGT
cataaccttataaaatggcc

SEQ ID NO: 18965 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aaacctttcccacaatgtta

SEQ ID NO: 18966 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tgttattggataaaaactgc

SEQ ID NO: 18967 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aagaaaaacactggacaaaa

SEQ ID NO: 18968 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ttgtttttgttttttcccca

SEQ ID NO: 18969 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aaagtgagatacagtacttg

SEQ ID NO: 18970 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tctaattcctcatgtcacac

SEQ ID NO: 18971 - DNA, 20 bp, Artificial Sequence
  Description of Artificial Sequence: Synthetic oligonucleotide
  Target: ATXN1; (+) strand; PAM type: NNGRRT; PAM sequence: CCGAGT
aaaaaaaaaaaaagtggcac

SEQ ID NO: 18972 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tcatgaactataaacagtac

SEQ ID NO: 18973 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gcagtttgcatctacctctt

SEQ ID NO: 18974 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aacactgcacagaaaccagc

SEQ ID NO: 18975 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gtctccgcgatgccctgaag

SEQ ID NO: 18976 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ccggcccatgccgatagcaa

SEQ ID NO: 18977 - DNA, 20 bp, Artificial Sequence
  Description of Artificial Sequence: Synthetic oligonucleotide
  Target: ATXN1; (+) strand; PAM type: NNGRRT; PAM sequence: GGGAGT
acttttctcctgacactagc

SEQ ID NO: 18978 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gccccgttcctttcttcccc

SEQ ID NO: 18979 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ttagcctacagtacagtaat

SEQ ID NO: 18980 - DNA, 20 bp, Artificial Sequence
  Description of Artificial Sequence: Synthetic oligonucleotide
  Target: ATXN1; (+) strand; PAM type: NNGRRT; PAM sequence: AGGAAT
atgcaaatcttaacctcctg

SEQ ID NO: 18981 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ggaattagagaaggcttagg

SEQ ID NO: 18982 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcctcgttgccgcgggcttg

SEQ ID NO: 18983 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gcccgccaggccgtcggcct

SEQ ID NO: 18984 - DNA, 20 bp, Artificial Sequence
  Description of Artificial Sequence: Synthetic oligonucleotide
  Target: ATXN1; (+) strand; PAM type: NNGRRT; PAM sequence: CGGGAT
gtgcttcagcaggacgctgg

SEQ ID NO: 18985 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gagccgttcttcaggttctt

SEQ ID NO: 18986 - DNA, 20 bp, Artificial Sequence
  Description of Artificial Sequence: Synthetic oligonucleotide
  Target: ATXN1; (+) strand; PAM type: NNGRRT; PAM sequence: GAGAGT
agatgcagacatccccaact

SEQ ID NO: 18987 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ggctggttctctccggacag

SEQ ID NO: 18988 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gccctgtccaaacacaaaaa

SEQ ID NO: 18989 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctcacacagacacacacagg

SEQ ID NO: 18990 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tataaatgaggctcttctct

SEQ ID NO: 18991 - DNA, 20 bp, Artificial Sequence
  Description of Artificial Sequence: Synthetic oligonucleotide
  Target: ATXN1; (+) strand; PAM type: NNGRRT; PAM sequence: ATGGAT
catacaggacaggactaaac

SEQ ID NO: 18992 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ggacaggactaaacatggat

SEQ ID NO: 18993 - DNA, 20 bp, Artificial Sequence
  Description of Artificial Sequence: Synthetic oligonucleotide
  Target: ATXN1; (+) strand; PAM type: NNGRRT; PAM sequence: GTGAGT
acatggatcagagtgagact

SEQ ID NO: 18994 - DNA, 20 bp, Artificial Sequence
  Description of Artificial Sequence: Synthetic oligonucleotide
  Target: ATXN1; (+) strand; PAM type: NNGRRT; PAM sequence: CTGAGT
caggcacagtgtgtttatca

SEQ ID NO: 18995 - DNA, 20 bp, Artificial Sequence
  Description of Artificial Sequence: Synthetic oligonucleotide
  Target: ATXN1; (+) strand; PAM type: NNGRRT; PAM sequence: AAGGAT
actgagtccccagcccctaa

SEQ ID NO: 18996 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cagcactttgggacaccaag

SEQ ID NO: 18997 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggacaccaaggtgg

SEQ ID NO: 18998 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggtggatcatttgaggtc

SEQ ID NO: 18999 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tacttgggaggctgaaacac

SEQ ID NO: 19000 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gggcgatccagcctgggcca

SEQ ID NO: 19001 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccaaggcgc

SEQ ID NO: 19002 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgcgtggatcacctgaggtc

SEQ ID NO: 19003 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcag

SEQ ID NO: 19004 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ggctgaggcaggagaatcgt

SEQ ID NO: 19005 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcaa

SEQ ID NO: 19006 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cttcactccagcctgggcga

SEQ ID NO: 19007 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cacacacacacacacacttc

SEQ ID NO: 19008 - DNA, 20 bp, Artificial Sequence
  Description of Artificial Sequence: Synthetic oligonucleotide
  Target: ATXN1; (+) strand; PAM type: NNGRRT; PAM sequence: TTGGAT
acacacacacacttcctggg

SEQ ID NO: 19009 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agagcatagggaacaggtaa

SEQ ID NO: 19010 - DNA, 20 bp, Artificial Sequence
  Description of Artificial Sequence: Synthetic oligonucleotide
  Target: ATXN1; (+) strand; PAM type: NNGRRT; PAM sequence: CAGGAT
agggaacaggtaatggagtt

SEQ ID NO: 19011 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gagttcaggatacaccaagg

SEQ ID NO: 19012 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ctctggtgagccccattctt

SEQ ID NO: 19013 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tgaagctcagattgactcat

SEQ ID NO: 19014 - DNA, 20 bp, Artificial Sequence
  Description of Artificial Sequence: Synthetic oligonucleotide
  Target: ATXN1; (+) strand; PAM type: NNGRRT; PAM sequence: CTGGAT
actcatctgagtccctaaaa

SEQ ID NO: 19015 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cctaaaactggattaaggtc

SEQ ID NO: 19016 - DNA, 20 bp, Artificial Sequence
  Description of Artificial Sequence: Synthetic oligonucleotide
  Target: ATXN1; (+) strand; PAM type: NNGRRT; PAM sequence: GGGGGT
aagcattcaatttaaaaaag

SEQ ID NO: 19017 - DNA, 20 bp, Artificial Sequence
  Description of Artificial Sequence: Synthetic oligonucleotide
  Target: ATXN1; (+) strand; PAM type: NNGRRT; PAM sequence: AAGGAT
caaaatatcagatcttaaaa

SEQ ID NO: 19018 - DNA, 20 bp, Artificial Sequence
  Description of Artificial Sequence: Synthetic oligonucleotide
  Target: ATXN1; (+) strand; PAM type: NNGRRT; PAM sequence: TAGAGT
atgcaccagggcttctcata

SEQ ID NO: 19019 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aagaagattaaagacagctt

SEQ ID NO: 19020 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tgagaattttgataggaaac

SEQ ID NO: 19021 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ctttgggaggctgagacagg

SEQ ID NO: 19022 - DNA, 20 bp, Artificial Sequence
  Description of Artificial Sequence: Synthetic oligonucleotide
  Target: ATXN1; (+) strand; PAM type: NNGRRT; PAM sequence: AGGAGT
agggaggatcacttgaggcc

SEQ ID NO: 19023 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tactcaggaggctgaggcag

SEQ ID NO: 19024 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggcaggaggatcttgagccc

SEQ ID NO: 19025 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactccagcctggacaa

SEQ ID NO: 19026 - DNA, 20 bp, Artificial Sequence
  Description of Artificial Sequence: Synthetic oligonucleotide
  Target: ATXN1; (+) strand; PAM type: NNGRRT; PAM sequence: GAGAAT
attaattaaaaaaggtctat

SEQ ID NO: 19027 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aaaaaggtctatgagaattg

SEQ ID NO: 19028 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaatatacaccactgaaatc

SEQ ID NO: 19029 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gaatgcaatgagctttccag

SEQ ID NO: 19030 - DNA, 20 bp, Artificial Sequence
  Description of Artificial Sequence: Synthetic oligonucleotide
  Target: ATXN1; (+) strand; PAM type: NNGRRT; PAM sequence: ATGGAT
agctttccagttgaatagac

SEQ ID NO: 19031 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tgaatagacatggattaaga

SEQ ID NO: 19032 - DNA, 20 bp, Artificial Sequence
  Description of Artificial Sequence: Synthetic oligonucleotide
  Target: ATXN1; (+) strand; PAM type: NNGRRT; PAM sequence: CTGGAT
attaagaaagaattcaggaa

SEQ ID NO: 19033 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gagctttagaagagactcca

SEQ ID NO: 19034 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aagatggtcaatatggagga

SEQ ID NO: 19035 - DNA, 20 bp, Artificial Sequence
  Description of Artificial Sequence: Synthetic oligonucleotide
  Target: ATXN1; (+) strand; PAM type: NNGRRT; PAM sequence: TAGGAT
aggagagggtaagagacaca

SEQ ID NO: 19036 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ggggctaacagacacataat

SEQ ID NO: 19037 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tacttgaggaggtaatggct

SEQ ID NO: 19038 - DNA, 20 bp, Artificial Sequence
  Description of Artificial Sequence: Synthetic oligonucleotide
  Target: ATXN1; (+) strand; PAM type: NNGRRT; PAM sequence: AAGGAT
agaattttcccaaactgaag

SEQ ID NO: 19039 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aaatcctcactgaggcagat

SEQ ID NO: 19040 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttaaaagcctctagaacagg

SEQ ID NO: 19041 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cagcactttgggaggccgag

SEQ ID NO: 19042 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccgaggtgg

SEQ ID NO: 19043 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggtggattacctgaggtc

SEQ ID NO: 19044 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcggggggctgaggcag

SEQ ID NO: 19045 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ccagtagacaatggagacaa

SEQ ID NO: 19046 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tctttacagtgctaaagaaa

SEQ ID NO: 19047 - DNA, 20 bp, Artificial Sequence
  Description of Artificial Sequence: Synthetic oligonucleotide
  Target: ATXN1; (+) strand; PAM type: NNGRRT; PAM sequence: GCGAAT
aagaaaaagaattgtcaatg

SEQ ID NO: 19048 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atggagcaaaaagatccttc

SEQ ID NO: 19049 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttcagacaaacagtaattaa

SEQ ID NO: 19050 - DNA, 20 bp, Artificial Sequence
  Description of Artificial Sequence: Synthetic oligonucleotide
  Target: ATXN1; (+) strand; PAM type: NNGRRT; PAM sequence: AGGAAT
agattgaagtttgtacaggg

SEQ ID NO: 19051 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ttgtacagggaggaatgaag

SEQ ID NO: 19052 - DNA, 20 bp, Artificial Sequence
  Description of Artificial Sequence: Synthetic oligonucleotide
  Target: ATXN1; (+) strand; PAM type: NNGRRT; PAM sequence: GTGAAT
atgaaaatggtagatacatg

SEQ ID NO: 19053 - DNA, 20 bp, Artificial Sequence
  Description of Artificial Sequence: Synthetic oligonucleotide
  Target: ATXN1; (+) strand; PAM type: NNGRRT; PAM sequence: CTGAAT
atggtagatacatggtgaat

SEQ ID NO: 19054 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tagatacatggtgaatctga

SEQ ID NO: 19055 - DNA, 20 bp, Artificial Sequence
  Description of Artificial Sequence: Synthetic oligonucleotide
  Target: ATXN1; (+) strand; PAM type: NNGRRT; PAM sequence: TTGGAT
taacaatatttaaaatattg

SEQ ID NO: 19056 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ctttttttctttttgtgaga

SEQ ID NO: 19057 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tcttgctctgtcgcccaggc

SEQ ID NO: 19058 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ctcactgcaatctccgcctc

SEQ ID NO: 19059 - DNA, 20 bp, Artificial Sequence
  Description of Artificial Sequence: Synthetic oligonucleotide
  Target: ATXN1; (+) strand; PAM type: NNGRRT; PAM sequence: GCGAGT
tctccgcctcccgggttcaa

SEQ ID NO: 19060 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gctactttttgtatttttag

SEQ ID NO: 19061 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gggggcttcaccatgttggc

SEQ ID NO: 19062 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagtctcccaaagtgc

SEQ ID NO: 19063 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gccaccgtgtcaggcctcca

SEQ ID NO: 19064 - DNA, 20 bp, Artificial Sequence
  Description of Artificial Sequence: Synthetic oligonucleotide
  Target: ATXN1; (+) strand; PAM type: NNGRRT; PAM sequence: TAGAAT
atctagttctgatacatttc

SEQ ID NO: 19065 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ttctagaatgacagacttta

SEQ ID NO: 19066 - DNA, 20 bp, Artificial Sequence
  Description of Artificial Sequence: Synthetic oligonucleotide
  Target: ATXN1; (+) strand; PAM type: NNGRRT; PAM sequence: TTGAGT
atatttttagaagagacaac

SEQ ID NO: 19067 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gtgaagcaagctaaaagttt

SEQ ID NO: 19068 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgttcataatagtattagta

SEQ ID NO: 19069 - DNA, 20 bp, Artificial Sequence
  Description of Artificial Sequence: Synthetic oligonucleotide
  Target: ATXN1; (+) strand; PAM type: NNGRRT; PAM sequence: ACGAAT
cttccaattttgtaaatttt

SEQ ID NO: 19070 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aatgtcatagctattagcta

SEQ ID NO: 19071 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tagctattagctaatgggtt

SEQ ID NO: 19072 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cctgctaccccccaacagtg

SEQ ID NO: 19073 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tgaatattgactgaaataag

SEQ ID NO: 19074 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tacaagtgactgtatcagat

SEQ ID NO: 19075 - DNA, 20 bp, Artificial Sequence
  Description of Artificial Sequence: Synthetic oligonucleotide
  Target: ATXN1; (+) strand; PAM type: NNGRRT; PAM sequence: TAGAGT
agatcctcttgcaaacctct

SEQ ID NO: 19076 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tgtctcgtaagactctctac

SEQ ID NO: 19077 - DNA, 20 bp, Artificial Sequence
  Description of Artificial Sequence: Synthetic oligonucleotide
  Target: ATXN1; (+) strand; PAM type: NNGRRT; PAM sequence: CCGGAT
ttttctggttctgcgtgttc

SEQ ID NO: 19078 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tctcataggtaaacttatct

SEQ ID NO: 19079 - DNA, 20 bp, Artificial Sequence
  Description of Artificial Sequence: Synthetic oligonucleotide
  Target: ATXN1; (+) strand; PAM type: NNGRRT; PAM sequence: CAGGAT
taattgattagtgcaaaagt

SEQ ID NO: 19080 - DNA, 20 bp, Artificial Sequence
  Description of Artificial Sequence: Synthetic oligonucleotide
  Target: ATXN1; (+) strand; PAM type: NNGRRT; PAM sequence: AAGGGT
actaactccatttttgttta

SEQ ID NO: 19081 - DNA, 20 bp, Artificial Sequence
  Description of Artificial Sequence: Synthetic oligonucleotide
  Target: ATXN1; (+) strand; PAM type: NNGRRT; PAM sequence: TAGGAT
accctttcctgcacgtaggc

SEQ ID NO: 19082 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gtacttttagaaactaactc

SEQ ID NO: 19083 - DNA, 20 bp, Artificial Sequence
  Description of Artificial Sequence: Synthetic oligonucleotide
  Target: ATXN1; (+) strand; PAM type: NNGRRT; PAM sequence: AGGAGT
atatattgttaaagactgat

SEQ ID NO: 19084 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggccgaggcgg

SEQ ID NO: 19085 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggcggatcacctgaggtc

SEQ ID NO: 19086 - DNA, 20 bp, Artificial Sequence
  Description of Artificial Sequence: Synthetic oligonucleotide
  Target: ATXN1; (+) strand; PAM type: NNGRRT; PAM sequence: ATGGAT
caaaattattatttcttgag

SEQ ID NO: 19087 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ggattctctgttgcccaggc

SEQ ID NO: 19088 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tattctcctgtctcagcctc

SEQ ID NO: 19089 - DNA, 20 bp, Artificial Sequence
  Description of Artificial Sequence: Synthetic oligonucleotide
  Target: ATXN1; (+) strand; PAM type: NNGRRT; PAM sequence: GTGGGT
agagatggtgtttggccatt

SEQ ID NO: 19090 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gccttggcatcccaaagtgc

SEQ ID NO: 19091 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tcatctctcgtatttggctt

SEQ ID NO: 19092 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aagttcagttacagaggtgc

SEQ ID NO: 19093 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aaatctccaaagacaggcct

SEQ ID NO: 19094 - DNA, 20 bp, Artificial Sequence
  Description of Artificial Sequence: Synthetic oligonucleotide
  Target: ATXN1; (+) strand; PAM type: NNGRRT; PAM sequence: GAGAAT
agagaaaagtgatggagaga

SEQ ID NO: 19095 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ctaaaacaagatgacgttaa

SEQ ID NO: 19096 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttttttttttttttttgaga

SEQ ID NO: 19097 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcgctctgtcacccaggt

SEQ ID NO: 19098 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ctcactgcaatctctgcctc

SEQ ID NO: 19099 - DNA, 20 bp, Artificial Sequence
  Description of Artificial Sequence: Synthetic oligonucleotide
  Target: ATXN1; (+) strand; PAM type: NNGRRT; PAM sequence: AGGGAT
gcctcagcctcccaagtagc

SEQ ID NO: 19100 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttttatatttttagtagaca

SEQ ID NO: 19101 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gccacagcctcccaaaatgc

SEQ ID NO: 19102 - DNA, 20 bp, Artificial Sequence
  Description of Artificial Sequence: Synthetic oligonucleotide
  Target: ATXN1; (+) strand; PAM type: NNGRRT; PAM sequence: GTGAGT
aaaatgctaggattacagaa

SEQ ID NO: 19103 - DNA, 20 bp, Artificial Sequence
  Description of Artificial Sequence: Synthetic oligonucleotide
  Target: ATXN1; (+) strand; PAM type: NNGRRT; PAM sequence: CTGGGT
atgccacgaccagatatcag

SEQ ID NO: 19104 - DNA, 20 bp, Artificial Sequence
  Description of Artificial Sequence: Synthetic oligonucleotide
  Target: ATXN1; (+) strand; PAM type: NNGRRT; PAM sequence: TCGGAT
ctgatcattgtaggcacaga

SEQ ID NO: 19105 - DNA, 20 bp, Artificial Sequence
  Description of Artificial Sequence: Synthetic oligonucleotide
  Target: ATXN1; (+) strand; PAM type: NNGRRT; PAM sequence: TGGGGT
acaatgtactttttccccct

SEQ ID NO: 19106 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tactttttcccccttggggt

SEQ ID NO: 19107 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tttataattaggtttgtcat

SEQ ID NO: 19108 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ttaatgaagaaatctcactg

SEQ ID NO: 19109 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tcactgaggggtttctcagt

SEQ ID NO: 19110 - DNA, 20 bp, Artificial Sequence
  Description of Artificial Sequence: Synthetic oligonucleotide
  Target: ATXN1; (+) strand; PAM type: NNGRRT; PAM sequence: TTGGAT
caatgccagcggggactggt

SEQ ID NO: 19111 - DNA, 20 bp, Artificial Sequence
  Description of Artificial Sequence: Synthetic oligonucleotide
  Target: ATXN1; (+) strand; PAM type: NNGRRT; PAM sequence: TAGGAT
acagagacggtgtgattttg

SEQ ID NO: 19112 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tcaactggaacaataagtct

SEQ ID NO: 19113 - DNA, 20 bp, Artificial Sequence
  Description of Artificial Sequence: Synthetic oligonucleotide
  Target: ATXN1; (+) strand; PAM type: NNGRRT; PAM sequence: TTGAAT
acaataagtctgtgaattcc

SEQ ID NO: 19114 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tccttgaatttaaaacccat

SEQ ID NO: 19115 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tattatttttttttttgaga

SEQ ID NO: 19116 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tcttgctctgttgcccaggc

SEQ ID NO: 19117 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcactgcaaactccacctc

SEQ ID NO: 19118 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gattctcctgcctcagcctc

SEQ ID NO: 19119 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttttgtatgtttagtagaga

SEQ ID NO: 19120 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gccttggcctcctaaagtgc

SEQ ID NO: 19121 - DNA, 20 bp, Artificial Sequence
  Description of Artificial Sequence: Synthetic oligonucleotide
  Target: ATXN1; (+) strand; PAM type: NNGRRT; PAM sequence: GAGGGT
cccggcctcaaaatattatt

SEQ ID NO: 19122 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctaagtgttaggaaccttag

SEQ ID NO: 19123 - DNA, 20 bp, Artificial Sequence
  Description of Artificial Sequence: Synthetic oligonucleotide
  Target: ATXN1; (+) strand; PAM type: NNGRRT; PAM sequence: ACGGGT
agacagaacatacacgcaaa

SEQ ID NO: 19124 - DNA, 20 bp, Artificial Sequence
  Description of Artificial Sequence: Synthetic oligonucleotide
  Target: ATXN1; (+) strand; PAM type: NNGRRT; PAM sequence: TCGAAT
cgatgacgtccactcagatg

SEQ ID NO: 19125 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ggctgttcaatcaagcacct

SEQ ID NO: 19126 - DNA, 20 bp, Artificial Sequence
  Description of Artificial Sequence: Synthetic oligonucleotide
  Target: ATXN1; (+) strand; PAM type: NNGRRT; PAM sequence: ATGGGT
cccaattataagcaaactgt

SEQ ID NO: 19127 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gttccttttccaaatacacc

SEQ ID NO: 19128 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgctactctctccattcatt

SEQ ID NO: 19129 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ttcctttttttattttgaga

SEQ ID NO: 19130 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tcttgttctgttgcccaggc

SEQ ID NO: 19131 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tatcttcctgcctcagccgc

SEQ ID NO: 19132 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ccccttctcctctttatacc

SEQ ID NO: 19133 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tattgtaaactgcgcatgca

SEQ ID NO: 19134 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ccaggttgtgcactccttat

SEQ ID NO: 19135 - DNA, 20 bp, Artificial Sequence
  Description of Artificial Sequence: Synthetic oligonucleotide
  Target: ATXN1; (+) strand; PAM type: NNGRRT; PAM sequence: CAGAGT
caaactcagtgttctatctc

SEQ ID NO: 19136 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggcgggctgatcatgaggtc

SEQ ID NO: 19137 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactctgaaggctgaagcag

SEQ ID NO: 19138 - DNA, 20 bp, Artificial Sequence
  Description of Artificial Sequence: Synthetic oligonucleotide
  Target: ATXN1; (+) strand; PAM type: NNGRRT; PAM sequence: AAGAAT
caaaacaaaaaaaaaactga

SEQ ID NO: 19139 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gagaggagcagtgctttctc

SEQ ID NO: 19140 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ctgaggtcgtcatgatttta

SEQ ID NO: 19141 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aagtcattttatgatcttgc

SEQ ID NO: 19142 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctggggttccacacattttc

SEQ ID NO: 19143 - DNA, 20 bp, Artificial Sequence
  Description of Artificial Sequence: Synthetic oligonucleotide
  Target: ATXN1; (+) strand; PAM type: NNGRRT; PAM sequence: TAGAAT
caaacaccctaagcagtaag

SEQ ID NO: 19144 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttctttctttttttttgaga

SEQ ID NO: 19145 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tctcactctgtcgccaaggc

SEQ ID NO: 19146 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaagtagc

SEQ ID NO: 19147 - DNA, 20 bp, Artificial Sequence
  Description of Artificial Sequence: Synthetic oligonucleotide
  Target: ATXN1; (+) strand; PAM type: NNGRRT; PAM sequence: ACGGGT
tttttttgtatttagtagag

SEQ ID NO: 19148 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcggcctcccaaagtgc

SEQ ID NO: 19149 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aggtgtgagccaccgcgccc

SEQ ID NO: 19150 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gggccctctgtctttcatct

SEQ ID NO: 19151 - DNA, 20 bp, Artificial Sequence
  Description of Artificial Sequence: Synthetic oligonucleotide
  Target: ATXN1; (+) strand; PAM type: NNGRRT; PAM sequence: GGGGGT
cgccagcacctcttgctttt

SEQ ID NO: 19152 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tgtcacctccaactcccatt

SEQ ID NO: 19153 - DNA, 20 bp, Artificial Sequence
  Description of Artificial Sequence: Synthetic oligonucleotide
  Target: ATXN1; (+) strand; PAM type: NNGRRT; PAM sequence: AAGAGT
atgtctcccatttccttcac

SEQ ID NO: 19154 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttcgcctgttgctgggagca

SEQ ID NO: 19155 - DNA, 20 bp, Artificial Sequence
  Description of Artificial Sequence: Synthetic oligonucleotide
  Target: ATXN1; (+) strand; PAM type: NNGRRT; PAM sequence: GGGGGT
aaccccgtctcaaagatgaa

SEQ ID NO: 19156 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aaacagtcaaaacgctttgg

SEQ ID NO: 19157 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaacgctttggctgagtgt

SEQ ID NO: 19158 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ggctgagtgtaagaatctct

SEQ ID NO: 19159 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgagtgttctatttaaaaca

SEQ ID NO: 19160 - DNA, 20 bp, Artificial Sequence
  Description of Artificial Sequence: Synthetic oligonucleotide
  Target: ATXN1; (+) strand; PAM type: NNGRRT; PAM sequence: CAGGGT
agtccttggtggaagtgttt

SEQ ID NO: 19161 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cacaaatcccacattaaaag

SEQ ID NO: 19162 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aaggccctgtggggaggctc

SEQ ID NO: 19163 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gccaggaaggacactgccca

SEQ ID NO: 19164 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aatgtgtgccttaggcaggg

SEQ ID NO: 19165 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actttgggggcctgaggcgg

SEQ ID NO: 19166 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggaggatcacatgagctc

SEQ ID NO: 19167 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tcctagggaggctgaagtgg

SEQ ID NO: 19168 - DNA, 20 bp, Artificial Sequence
  Description of Artificial Sequence: Synthetic oligonucleotide
  Target: ATXN1; (+) strand; PAM type: NNGRRT; PAM sequence: CCGGAT
caatgtgaaaaggcgacata

SEQ ID NO: 19169 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ggaacaggcaaaactatgga

SEQ ID NO: 19170 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tggagagagtaaaatgatca

SEQ ID NO: 19171 - DNA, 20 bp, Artificial Sequence
  Description of Artificial Sequence: Synthetic oligonucleotide
  Target: ATXN1; (+) strand; PAM type: NNGRRT; PAM sequence: AGGAGT
taaaatgatcagtgggtgcc

SEQ ID NO: 19172 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tgggtgccaggagtttcagg

SEQ ID NO: 19173 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ggacaaatagttgatgcata

SEQ ID NO: 19174 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gttgatgcataagggatttt

SEQ ID NO: 19175 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ttctgtataataatgtaatg

SEQ ID NO: 19176 - DNA, 20 bp, Artificial Sequence
  Description of Artificial Sequence: Synthetic oligonucleotide
  Target: ATXN1; (+) strand; PAM type: NNGRRT; PAM sequence: CAGAGT
caaaaacagcatgtacaaca

SEQ ID NO: 19177 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tataaacaacaacagtctga

SEQ ID NO: 19178 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ctatctattttttgatacat

SEQ ID NO: 19179 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ggcatgttcaatgttggcaa

SEQ ID NO: 19180 - DNA, 20 bp, Artificial Sequence
  Description of Artificial Sequence: Synthetic oligonucleotide
  Target: ATXN1; (+) strand; PAM type: NNGRRT; PAM sequence: TAGAAT
agaagtcaaccaaaaaatag

SEQ ID NO: 19181 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtcgggaggaggaaatggca

SEQ ID NO: 19182 - DNA, 20 bp, Artificial Sequence
  Description of Artificial Sequence: Synthetic oligonucleotide
  Target: ATXN1; (+) strand; PAM type: NNGRRT; PAM sequence: CCGAGT
cactgaatattaagcagcca

SEQ ID NO: 19183 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tcagagaagctgaacctagg

SEQ ID NO: 19184 - DNA, 20 bp, Artificial Sequence
  Description of Artificial Sequence: Synthetic oligonucleotide
  Target: ATXN1; (+) strand; PAM type: NNGRRT; PAM sequence: AAGGAT
acctaggaagggtgagacag

SEQ ID NO: 19185 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ggaagggtgagacagaagga

SEQ ID NO: 19186 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ttagaaacaggaacggcggg

SEQ ID NO: 19187 - DNA, 20 bp, Artificial Sequence
  Description of Artificial Sequence: Synthetic oligonucleotide
  Target: ATXN1; (+) strand; PAM type: NNGRRT; PAM sequence: CGGGAT
gtgctcgcctcggccactcg

SEQ ID NO: 19188 - DNA, 20 bp, Artificial Sequence
  Description of Artificial Sequence: Synthetic oligonucleotide
  Target: ATXN1; (+) strand; PAM type: NNGRRT; PAM sequence: GAGGAT
cactcgcgggattccacccc

SEQ ID NO: 19189 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tccaccccgaggattacagg

SEQ ID NO: 19190 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ctttgatttatttttcagct

SEQ ID NO: 19191 - DNA, 20 bp, Artificial Sequence
  Description of Artificial Sequence: Synthetic oligonucleotide
  Target: ATXN1; (+) strand; PAM type: NNGRRT; PAM sequence: ACGGGT
acaaggtcccagtgctactg

SEQ ID NO: 19192 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cccagtgctactgacgggtg

SEQ ID NO: 19193 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tgcgaagccccatccttctt

SEQ ID NO: 19194 - DNA, 20 bp, Artificial Sequence
  Description of Artificial Sequence: Synthetic oligonucleotide
  Target: ATXN1; (+) strand; PAM type: NNGRRT; PAM sequence: GGGGGT
cacgttgatgctatcgcctc

SEQ ID NO: 19195 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tatcgcctcgggggtcgcat

SEQ ID NO: 19196 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gacttatggcctcaaacttg

SEQ ID NO: 19197 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tcaaacttggaggatattaa

SEQ ID NO: 19198 - DNA, 20 bp, Artificial Sequence
  Description of Artificial Sequence: Synthetic oligonucleotide
  Target: ATXN1; (+) strand; PAM type: NNGRRT; PAM sequence: CAGAAT
catcctttgggactctcaac

SEQ ID NO: 19199 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gcaaagcagcaactctcttc

SEQ ID NO: 19200 - DNA, 20 bp, Artificial Sequence
  Description of Artificial Sequence: Synthetic oligonucleotide
  Target: ATXN1; (+) strand; PAM type: NNGRRT; PAM sequence: GGGGAT
agcacctaggtgggggcctg

SEQ ID NO: 19201 - DNA, 20 bp, Artificial Sequence
  Description of Artificial Sequence: Synthetic oligonucleotide
  Target: ATXN1; (+) strand; PAM type: NNGRRT; PAM sequence: TCGAGT
gggatgcatagacgctttgc

SEQ ID NO: 19202 - DNA, 20 bp, Artificial Sequence
  Description of Artificial Sequence: Synthetic oligonucleotide
  Target: ATXN1; (+) strand; PAM type: NNGRRT; PAM sequence: AGGGAT
actgggcagggcaatgccac

SEQ ID NO: 19203 - DNA, 20 bp, Artificial Sequence
  Description of Artificial Sequence: Synthetic oligonucleotide
  Target: ATXN1; (+) strand; PAM type: NNGRRT; PAM sequence: AGGAAT
atctttccacagtcttaatg

SEQ ID NO: 19204 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tcaagagattatctcctatg

SEQ ID NO: 19205 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cagcattttgggagaccgag

SEQ ID NO: 19206 - DNA, 20 bp, Artificial Sequence
  Description of Artificial Sequence: Synthetic oligonucleotide
  Target: ATXN1; (+) strand; PAM type: NNGRRT; PAM sequence: GTGGAT
attttgggagaccgaggtgg

SEQ ID NO: 19207 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggtggatcgcttgagccc

SEQ ID NO: 19208 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aaaaaaacacagaaaattag

SEQ ID NO: 19209 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tactggggaggctgaggtgg

SEQ ID NO: 19210 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ggctgaggtgggaggatcaa

SEQ ID NO: 19211 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcccatcactgcacttcagc

SEQ ID NO: 19212 - DNA, 20 bp, Artificial Sequence
  Description of Artificial Sequence: Synthetic oligonucleotide
  Target: ATXN1; (+) strand; PAM type: NNGRRT; PAM sequence: GAGAGT
catttgcctggtttagagag

SEQ ID NO: 19213 - DNA, 20 bp, Artificial Sequence
  Description of Artificial Sequence: Synthetic oligonucleotide
  Target: ATXN1; (+) strand; PAM type: NNGRRT; PAM sequence: CTGGGT
agagacccaaatccgcaccc

SEQ ID NO: 19214 - DNA, 20 bp, Artificial Sequence
  Description of Artificial Sequence: Synthetic oligonucleotide
  Target: ATXN1; (+) strand; PAM type: NNGRRT; PAM sequence: GGGGGT
tatatcacactgctttccct

SEQ ID NO: 19215 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ccctgggggtgtgatgttgg

SEQ ID NO: 19216 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tgtgatgttgggggggtctt

SEQ ID NO: 19217 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ttatgagttcaggcatcctc

SEQ ID NO: 19218 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tcctcaagagtctgttcatg

SEQ ID NO: 19219 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gttcatgcaggatttctgcc

SEQ ID NO: 19220 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gctcaacaatttgcacattt

SEQ ID NO: 19221 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gcacatttctgaatttctct

SEQ ID NO: 19222 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gaaggcactgcagaggggag

SEQ ID NO: 19223 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aacctcaattaagtccagat

SEQ ID NO: 19224 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ccccctctcatgctctctgt

SEQ ID NO: 19225 - DNA, 20 bp, Artificial Sequence
  Description of Artificial Sequence: Synthetic oligonucleotide
  Target: ATXN1; (+) strand; PAM type: NNGRRT; PAM sequence: TGGAGT
cttgtggcaaacacagctgg

SEQ ID NO: 19226 - DNA, 20 bp, Artificial Sequence
  Description of Artificial Sequence: Synthetic oligonucleotide
  Target: ATXN1; (+) strand; PAM type: NNGRRT; PAM sequence: TGGAGT
atcattaattttgcaaagtt

SEQ ID NO: 19227 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cccagctttaggaggctgag

SEQ ID NO: 19228 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gctttaggaggctgaggcgg

SEQ ID NO: 19229 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggtgaatcacctgaggtc

SEQ ID NO: 19230 - DNA, 20 bp, Artificial Sequence
  Description of Artificial Sequence: Synthetic oligonucleotide
  Target: ATXN1; (+) strand; PAM type: NNGRRT; PAM sequence: GGGGGT
taaaaatacaaaaattagca

SEQ ID NO: 19231 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tacttgggaggctgaggcag

SEQ ID NO: 19232 - DNA, 20 bp, Artificial Sequence
  Description of Artificial Sequence: Synthetic oligonucleotide
  Target: ATXN1; (+) strand; PAM type: NNGRRT; PAM sequence: CTGGGT
actgcactctgcactccagc

SEQ ID NO: 19233 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aaaaaaaaaaaaaaaaatag

SEQ ID NO: 19234 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tctgttcacaaaaatgtgtt

SEQ ID NO: 19235 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tttattttccatgtgtcacc

SEQ ID NO: 19236 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgtgtcacctggggtctgtg

SEQ ID NO: 19237 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gaagtgaacagccactacag

SEQ ID NO: 19238 - DNA, 20 bp, Artificial Sequence
  Description of Artificial Sequence: Synthetic oligonucleotide
  Target: ATXN1; (+) strand; PAM type: NNGRRT; PAM sequence: ACGAGT
gcccccatatccagtcattc

SEQ ID NO: 19239 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggaaggactgcttggagccc

SEQ ID NO: 19240 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gtcctagctactagggaggt

SEQ ID NO: 19241 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tactagggaggttggggtgg

SEQ ID NO: 19242 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tttttcttgttttattttat

SEQ ID NO: 19243 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ggaaggaggctctgtcccat

SEQ ID NO: 19244 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gcagtgaaagaaatgggctg

SEQ ID NO: 19245 - DNA, 20 bp, Artificial Sequence
  Description of Artificial Sequence: Synthetic oligonucleotide
  Target: ATXN1; (+) strand; PAM type: NNGRRT; PAM sequence: AAGGGT
atcgatctaagaacctggaa

SEQ ID NO: 19246 - DNA, 20 bp, Artificial Sequence
  Description of Artificial Sequence: Synthetic oligonucleotide
  Target: ATXN1; (+) strand; PAM type: NNGRRT; PAM sequence: GTGGAT
ctttgatattttagtgtctt

SEQ ID NO: 19247 - DNA, 20 bp, Artificial Sequence
  Description of Artificial Sequence: Synthetic oligonucleotide
  Target: ATXN1; (+) strand; PAM type: NNGRRT; PAM sequence: TAGGAT
cccagaggtatagtctctcc

SEQ ID NO: 19248 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttttttttttttgtctgaga

SEQ ID NO: 19249 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tcttgctgtgtgtccaaggc

SEQ ID NO: 19250 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ctcactgcaatccccacctc

SEQ ID NO: 19251 - DNA, 20 bp, Artificial Sequence
  Description of Artificial Sequence: Synthetic oligonucleotide
  Target: ATXN1; (+) strand; PAM type: NNGRRT; PAM sequence: TGGAGT
aattctcctacctcagcctc

SEQ ID NO: 19252 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcagcctctggagtagc

SEQ ID NO: 19253 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttttgtatttttagtagaga

SEQ ID NO: 19254 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaaagtgc

SEQ ID NO: 19255 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ccctacaccccagagcacac

SEQ ID NO: 19256 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gtgttctacacctcttggtg

SEQ ID NO: 19257 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tgtagagtgccctttcctct

SEQ ID NO: 19258 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gccctttcctcttgggatca

SEQ ID NO: 19259 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ataaaaattatctcgtcaaa

SEQ ID NO: 19260 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ccttgctatgttgcccaggc

SEQ ID NO: 19261 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gatcctcctgcctcagtctc

SEQ ID NO: 19262 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aataagacatattttaaaac

SEQ ID NO: 19263 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ttaaaacatggatgttgcaa

SEQ ID NO: 19264 - DNA, 20 bp, Artificial Sequence
  Description of Artificial Sequence: Synthetic oligonucleotide
  Target: ATXN1; (+) strand; PAM type: NNGRRT; PAM sequence: CCGAAT
tttcctggtaagaaaaagtg

SEQ ID NO: 19265 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gtccagcagcgtttcctaat

SEQ ID NO: 19266 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agggttcctcatcttaatca

SEQ ID NO: 19267 - DNA, 20 bp, Artificial Sequence
  Description of Artificial Sequence: Synthetic oligonucleotide
  Target: ATXN1; (+) strand; PAM type: NNGRRT; PAM sequence: TAGAGT
cacagaattcaaaaaataac

SEQ ID NO: 19268 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ttcaaaaaataactagagtg

SEQ ID NO: 19269 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ataactagagtggtgagttt

SEQ ID NO: 19270 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gagaacgcagttgggaaagg

SEQ ID NO: 19271 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttcaatcctctctacggtgc

SEQ ID NO: 19272 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tcgttgcttatctctgcact

SEQ ID NO: 19273 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tttagctccccgttggccaa

SEQ ID NO: 19274 - DNA, 20 bp, Artificial Sequence
  Description of Artificial Sequence: Synthetic oligonucleotide
  Target: ATXN1; (+) strand; PAM type: NNGRRT; PAM sequence: GTGGAT
acggactgcaccacaggcag

SEQ ID NO: 19275 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gatctgggcctgcaccatgg

SEQ ID NO: 19276 - DNA, 20 bp, Artificial Sequence
  Description of Artificial Sequence: Synthetic oligonucleotide
  Target: ATXN1; (+) strand; PAM type: NNGRRT; PAM sequence: CTGGGT
accatggctgggtaggcggc

SEQ ID NO: 19277 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ggcctgggtgaccagggcct

SEQ ID NO: 19278 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gaggcactgcagcaaactgg

SEQ ID NO: 19279 - DNA, 20 bp, Artificial Sequence
  Description of Artificial Sequence: Synthetic oligonucleotide
  Target: ATXN1; (+) strand; PAM type: NNGRRT; PAM sequence: CGGGAT
tccatgtcagtgctgccgac

SEQ ID NO: 19280 - DNA, 20 bp, Artificial Sequence
  Description of Artificial Sequence: Synthetic oligonucleotide
  Target: ATXN1; (+) strand; PAM type: NNGRRT; PAM sequence: GGGGAT
atgagcaggggctgtgtgcc

SEQ ID NO: 19281 - DNA, 20 bp, Artificial Sequence
  Description of Artificial Sequence: Synthetic oligonucleotide
  Target: ATXN1; (+) strand; PAM type: NNGRRT; PAM sequence: GGGGGT
cgctcaggtagccgatgaca

SEQ ID NO: 19282 - DNA, 20 bp, Artificial Sequence
  Description of Artificial Sequence: Synthetic oligonucleotide
  Target: ATXN1; (+) strand; PAM type: NNGRRT; PAM sequence: TTGAGT
aggtagccgatgacaggggg

SEQ ID NO: 19283 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ccgtggctggcagtcccacc

SEQ ID NO: 19284 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tctgaagcactgtgtgtggt

SEQ ID NO: 19285 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gtgtggtctgaatgaccgtg

SEQ ID NO: 19286 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tgcaggccacttttgtcgtt

SEQ ID NO: 19287 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gtagaaggggaggcttcacg

SEQ ID NO: 19288 - DNA, 20 bp, Artificial Sequence
  Description of Artificial Sequence: Synthetic oligonucleotide
  Target: ATXN1; (+) strand; PAM type: NNGRRT; PAM sequence: AAGGAT
cacagaggcccggacccccg

SEQ ID NO: 19289 - DNA, 20 bp, Artificial Sequence
  Description of Artificial Sequence: Synthetic oligonucleotide
  Target: ATXN1; (+) strand; PAM type: NNGRRT; PAM sequence: TCGGGT
actgctgtagtctgaggggc

SEQ ID NO: 19290 - DNA, 20 bp, Artificial Sequence
  Description of Artificial Sequence: Synthetic oligonucleotide
  Target: ATXN1; (+) strand; PAM type: NNGRRT; PAM sequence: ACGGGT
caccacgtgcctggactcgt

SEQ ID NO: 19291 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ccgttcaggacctccttggc

SEQ ID NO: 19292 - DNA, 20 bp, Artificial Sequence
  Description of Artificial Sequence: Synthetic oligonucleotide
  Target: ATXN1; (+) strand; PAM type: NNGRRT; PAM sequence: CGGAGT
ccgagggacaaagtggctgc

SEQ ID NO: 19293 - DNA, 20 bp, Artificial Sequence
  Description of Artificial Sequence: Synthetic oligonucleotide
  Target: ATXN1; (+) strand; PAM type: NNGRRT; PAM sequence: CAGGGT
acgacctgggaggggggccc

SEQ ID NO: 19294 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ggccccagggtgagcgtgtg

SEQ ID NO: 19295 - DNA, 20 bp, Artificial Sequence
  Description of Artificial Sequence: Synthetic oligonucleotide
  Target: ATXN1; (+) strand; PAM type: NNGRRT; PAM sequence: GGGGGT
gtgtgggatcatcgtctggt

SEQ ID NO: 19296 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tggtgggggtggaggtggac

SEQ ID NO: 19297 - DNA, 20 bp, Artificial Sequence
  Description of Artificial Sequence: Synthetic oligonucleotide
  Target: ATXN1; (+) strand; PAM type: NNGRRT; PAM sequence: CGGGGT
tgggctggtgggggggaccc

SEQ ID NO: 19298 - DNA, 20 bp, Artificial Sequence
  Description of Artificial Sequence: Synthetic oligonucleotide
  Target: ATXN1; (+) strand; PAM type: NNGRRT; PAM sequence: CAGAGT
agactgcccatgttggccag

SEQ ID NO: 19299 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gcccatgttggccagcagag

SEQ ID NO: 19300 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aggcctccagctgggagcgc

SEQ ID NO: 19301 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tccagctgggagcgctggga

SEQ ID NO: 19302 - DNA, 20 bp, Artificial Sequence
  Description of Artificial Sequence: Synthetic oligonucleotide
  Target: ATXN1; (+) strand; PAM type: NNGRRT; PAM sequence: CGGGGT
cgaggccactgcactggtga

SEQ ID NO: 19303 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gtgacggggttggcggttgg

SEQ ID NO: 19304 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gttggggggatcagctgtga

SEQ ID NO: 19305 - DNA, 20 bp, Artificial Sequence
  Description of Artificial Sequence: Synthetic oligonucleotide
  Target: ATXN1; (+) strand; PAM type: NNGRRT; PAM sequence: CGGGGT
gcgtactgcacgggggacac

SEQ ID NO: 19306 - DNA, 20 bp, Artificial Sequence
  Description of Artificial Sequence: Synthetic oligonucleotide
  Target: ATXN1; (+) strand; PAM type: NNGRRT; PAM sequence: CGGGGT
gacaccggggtccctggctg

SEQ ID NO: 19307 - DNA, 20 bp, Artificial Sequence
  Description of Artificial Sequence: Synthetic oligonucleotide
  Target: ATXN1; (+) strand; PAM type: NNGRRT; PAM sequence: GGGAGT
agacctgggagcgctgggcg

SEQ ID NO: 19308 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gcccccgtggccccggccac

SEQ ID NO: 19309 - DNA, 20 bp, Artificial Sequence
  Description of Artificial Sequence: Synthetic oligonucleotide
  Target: ATXN1; (+) strand; PAM type: NNGRRT; PAM sequence: CAGGGT
acccggtggttgtcgctggg

SEQ ID NO: 19310 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tcggaggaccggctggtggc

SEQ ID NO: 19311 - DNA, 20 bp, Artificial Sequence
  Description of Artificial Sequence: Synthetic oligonucleotide
  Target: ATXN1; (+) strand; PAM type: NNGRRT; PAM sequence: TTGGAT
attcgttgctccgctcttgg

SEQ ID NO: 19312 - DNA, 20 bp, Artificial Sequence
  Description of Artificial Sequence: Synthetic oligonucleotide
  Target: ATXN1; (+) strand; PAM type: NNGRRT; PAM sequence: CTGGAT
cacggtgactgtttcactgt

SEQ ID NO: 19313 - DNA, 20 bp, Artificial Sequence
  Description of Artificial Sequence: Synthetic oligonucleotide
  Target: ATXN1; (+) strand; PAM type: NNGRRT; PAM sequence: GGGGAT
agtcacatttgatttctgta

SEQ ID NO: 19314 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ggggatccaggctcttcatg

SEQ ID NO: 19315 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tcatgaggaatcatctcccc

SEQ ID NO: 19316 - DNA, 20 bp, Artificial Sequence
  Description of Artificial Sequence: Synthetic oligonucleotide
  Target: ATXN1; (+) strand; PAM type: NNGRRT; PAM sequence: CTGGAT
acaatccgccaacagcagct

SEQ ID NO: 19317 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgagaggctgaggcag

SEQ ID NO: 19318 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gtaacacatatattttttaa

SEQ ID NO: 19319 - DNA, 20 bp, Artificial Sequence
  Description of Artificial Sequence: Synthetic oligonucleotide
  Target: ATXN1; (+) strand; PAM type: NNGRRT; PAM sequence: CTGAAT
acagtccttgcactcgattt

SEQ ID NO: 19320 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctccaagattccccttagct

SEQ ID NO: 19321 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctgttctctgcaagtttcaa

SEQ ID NO: 19322 - DNA, 20 bp, Artificial Sequence
  Description of Artificial Sequence: Synthetic oligonucleotide
  Target: ATXN1; (+) strand; PAM type: NNGRRT; PAM sequence: CGGAGT
tacagccactcatatgatga

SEQ ID NO: 19323 - DNA, 20 bp, Artificial Sequence
  Description of Artificial Sequence: Synthetic oligonucleotide
  Target: ATXN1; (+) strand; PAM type: NNGRRT; PAM sequence: CCGAAT
cggagtgagactgttaaaaa

SEQ ID NO: 19324 - DNA, 20 bp, Artificial Sequence
  Description of Artificial Sequence: Synthetic oligonucleotide
  Target: ATXN1; (+) strand; PAM type: NNGRRT; PAM sequence: CTGAAT
acaaaaatagggctagtgca

SEQ ID NO: 19325 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gtgcactgaatgttttctca

SEQ ID NO: 19326 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ctcttactaaccactgaagt

SEQ ID NO: 19327 - DNA, 20 bp, Artificial Sequence
  Description of Artificial Sequence: Synthetic oligonucleotide
  Target: ATXN1; (+) strand; PAM type: NNGRRT; PAM sequence: GCGGAT
atgacccaggctagcaagca

SEQ ID NO: 19328 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tgctgtgattctgagagctg

SEQ ID NO: 19329 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gagctgtgggattgggcttt

SEQ ID NO: 19330 - DNA, 20 bp, Artificial Sequence
  Description of Artificial Sequence: Synthetic oligonucleotide
  Target: ATXN1; (+) strand; PAM type: NNGRRT; PAM sequence: TTGGGT
gctttgggaattccacaccc

SEQ ID NO: 19331 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tctttctttctttggagaga

SEQ ID NO: 19332 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tccttggcctcccaaagtgc

SEQ ID NO: 19333 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtactttttgtagagg

SEQ ID NO: 19334 - DNA, 20 bp, Artificial Sequence
  Description of Artificial Sequence: Synthetic oligonucleotide
  Target: ATXN1; (+) strand; PAM type: NNGRRT; PAM sequence: TGGGAT
cccacttggcctcccggtgc

SEQ ID NO: 19335 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atatcaaaggacatttcagt

SEQ ID NO: 19336 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aaaggacatttcagtaagaa

SEQ ID NO: 19337 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ctgaagaaatgaagtgttga

SEQ ID NO: 19338 - DNA, 20 bp, Artificial Sequence
  Description of Artificial Sequence: Synthetic oligonucleotide
  Target: ATXN1; (+) strand; PAM type: NNGRRT; PAM sequence: TGGAGT
caggtgttttttttttgaga

SEQ ID NO: 19339 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ctcactgcaacctccgcctc

SEQ ID NO: 19340 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gattctcctgcctcagcctc

SEQ ID NO: 19341 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcctgagtagc

SEQ ID NO: 19342 - DNA, 20 bp, Artificial Sequence
  Description of Artificial Sequence: Synthetic oligonucleotide
  Target: ATXN1; (+) strand; PAM type: NNGRRT; PAM sequence: CGGAGT
ttttgtatttttagtagagg

SEQ ID NO: 19343 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctctacctcccaaagtgc

SEQ ID NO: 19344 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gccactgcgccctgcccacc

SEQ ID NO: 19345 - DNA, 20 bp, Artificial Sequence
  Description of Artificial Sequence: Synthetic oligonucleotide
  Target: ATXN1; (+) strand; PAM type: NNGRRT; PAM sequence: GGGAAT
caagactcactcttaagaaa

SEQ ID NO: 19346 - DNA, 20 bp, Artificial Sequence
  Description of Artificial Sequence: Synthetic oligonucleotide
  Target: ATXN1; (+) strand; PAM type: NNGRRT; PAM sequence: CAGGGT
actgatccaataaaacccca

SEQ ID NO: 19347 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aaaccccacagggtttcatg

SEQ ID NO: 19348 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ttcatgagggatatttatgc

SEQ ID NO: 19349 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tttatgcaagagtgatgtgt

SEQ ID NO: 19350 - DNA, 20 bp, Artificial Sequence
  Description of Artificial Sequence: Synthetic oligonucleotide
  Target: ATXN1; (+) strand; PAM type: NNGRRT; PAM sequence: GGGAAT
atagtaggcccagccagtaa

SEQ ID NO: 19351 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aaatgtcaaacacattcagg

SEQ ID NO: 19352 - DNA, 20 bp, Artificial Sequence
  Description of Artificial Sequence: Synthetic oligonucleotide
  Target: ATXN1; (+) strand; PAM type: NNGRRT; PAM sequence: TTGAAT
atgtaacattgcctgtacaa

SEQ ID NO: 19353 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cagctttcgtaaatttgaaa

SEQ ID NO: 19354 - DNA, 20 bp, Artificial Sequence
  Description of Artificial Sequence: Synthetic oligonucleotide
  Target: ATXN1; (+) strand; PAM type: NNGRRT; PAM sequence: ACGGGT
gtactgataaggggaaaccc

SEQ ID NO: 19355 - DNA, 20 bp, Artificial Sequence
  Description of Artificial Sequence: Synthetic oligonucleotide
  Target: ATXN1; (+) strand; PAM type: NNGRRT; PAM sequence: TTGGGT
gggaaacccacgggtagaga

SEQ ID NO: 19356 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tgaaccaccagagggcgccc

SEQ ID NO: 19357 - DNA, 20 bp, Artificial Sequence
  Description of Artificial Sequence: Synthetic oligonucleotide
  Target: ATXN1; (+) strand; PAM type: NNGRRT; PAM sequence: TCGGGT
ggcaccacattcctggtcta

SEQ ID NO: 19358 - DNA, 20 bp, Artificial Sequence
  Description of Artificial Sequence: Synthetic oligonucleotide
  Target: ATXN1; (+) strand; PAM type: NNGRRT; PAM sequence: GAGAGT
aagaagaaaaaagaaaaaag

SEQ ID NO: 19359 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gaaaaaagaaaaaaggagag

SEQ ID NO: 19360 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gagagtgggatttctgctct

SEQ ID NO: 19361 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agacaactggcctctgtgtc

SEQ ID NO: 19362 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gccctcccaggggacccccg

SEQ ID NO: 19363 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tggaaaagggaaattggagg

SEQ ID NO: 19364 - DNA, 20 bp, Artificial Sequence
  Description of Artificial Sequence: Synthetic oligonucleotide
  Target: ATXN1; (+) strand; PAM type: NNGRRT; PAM sequence: ATGAAT
attggagggagagttaatag

SEQ ID NO: 19365 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tgaatcaagacaaatgtatt

SEQ ID NO: 19366 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tttgcctgataatcactgtt

SEQ ID NO: 19367 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctaggtgttgtacgtaaaca

SEQ ID NO: 19368 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tgatgctccactgcttcctc

SEQ ID NO: 19369 - DNA, 20 bp, Artificial Sequence
  Description of Artificial Sequence: Synthetic oligonucleotide
  Target: ATXN1; (+) strand; PAM type: NNGRRT; PAM sequence: ATGGAT
agaaattttttgctattacc

SEQ ID NO: 19370 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aaatgagatgcttctgtgct

SEQ ID NO: 19371 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gcttctgtgctagggatgtg

SEQ ID NO: 19372 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gtaaatagcagccaactgct

SEQ ID NO: 19373 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ctcagaatggaagatgctct

SEQ ID NO: 19374 - DNA, 20 bp, Artificial Sequence
  Description of Artificial Sequence: Synthetic oligonucleotide
  Target: ATXN1; (+) strand; PAM type: NNGRRT; PAM sequence: ATGGGT
cttaaacctagggcaagaaa

SEQ ID NO: 19375 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ccaatcctgtgcttctcagt

SEQ ID NO: 19376 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tatgcaaacactgaagaggg

SEQ ID NO: 19377 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cactgaagagggcagaatac

SEQ ID NO: 19378 - DNA, 20 bp, Artificial Sequence
  Description of Artificial Sequence: Synthetic oligonucleotide
  Target: ATXN1; (+) strand; PAM type: NNGRRT; PAM sequence: AAGGAT
agaggttacttgggcatgtc

SEQ ID NO: 19379 - DNA, 20 bp, Artificial Sequence
  Description of Artificial Sequence: Synthetic oligonucleotide
  Target: ATXN1; (+) strand; PAM type: NNGRRT; PAM sequence: TGGAGT
aggtccaaacccgacatgct

SEQ ID NO: 19380 - DNA, 20 bp, Artificial Sequence
  Description of Artificial Sequence: Synthetic oligonucleotide
  Target: ATXN1; (+) strand; PAM type: NNGRRT; PAM sequence: TAGAAT
cccgacatgcttggagtatc

SEQ ID NO: 19381 - DNA, 20 bp, Artificial Sequence
  Description of Artificial Sequence: Synthetic oligonucleotide
  Target: ATXN1; (+) strand; PAM type: NNGRRT; PAM sequence: GTGGAT
agtatctagaatggagaaag

SEQ ID NO: 19382 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ctagaatggagaaaggtgga

SEQ ID NO: 19383 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tgaacaggcatgcccccaaa

SEQ ID NO: 19384 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cgaagtaacagaaggctaga

SEQ ID NO: 19385 - DNA, 20 bp, Artificial Sequence
  Description of Artificial Sequence: Synthetic oligonucleotide
  Target: ATXN1; (+) strand; PAM type: NNGRRT; PAM sequence: GCGAAT
ggctagaagggatatatgtt

SEQ ID NO: 19386 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ccaggaaaattaagatcaat

SEQ ID NO: 19387 - DNA, 20 bp, Artificial Sequence
  Description of Artificial Sequence: Synthetic oligonucleotide
  Target: ATXN1; (+) strand; PAM type: NNGRRT; PAM sequence: CAGGGT
cagctcaattagcctactag

SEQ ID NO: 19388 - DNA, 20 bp, Artificial Sequence
  Description of Artificial Sequence: Synthetic oligonucleotide
  Target: ATXN1; (+) strand; PAM type: NNGRRT; PAM sequence: TAGGGT
caatatgaacaaccatttgg

SEQ ID NO: 19389 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aaaaaaatataatgttcagg

SEQ ID NO: 19390 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tacccaggaggctaaggcag

SEQ ID NO: 19391 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aagagaaagaaaacaatgtt

SEQ ID NO: 19392 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gaaaacaatgttcagaataa

SEQ ID NO: 19393 - DNA, 20 bp, Artificial Sequence
  Description of Artificial Sequence: Synthetic oligonucleotide
  Target: ATXN1; (+) strand; PAM type: NNGRRT; PAM sequence: ACGGGT
atactgcaaccatagatggc

SEQ ID NO: 19394 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ctgctgcaaaggcacgtggg

SEQ ID NO: 19395 - DNA, 20 bp, Artificial Sequence
  Description of Artificial Sequence: Synthetic oligonucleotide
  Target: ATXN1; (+) strand; PAM type: NNGRRT; PAM sequence: GGGAGT
aaggatggggcatgtctagg

SEQ ID NO: 19396 - DNA, 20 bp, Artificial Sequence
  Description of Artificial Sequence: Synthetic oligonucleotide
  Target: ATXN1; (+) strand; PAM type: NNGRRT; PAM sequence: ATGAGT
agaggtctggaggcaagcag

SEQ ID NO: 19397 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gagtaacagctgagacaact

SEQ ID NO: 19398 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aacagctgagacaactggga

SEQ ID NO: 19399 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctgcagcattaggaagcaat

SEQ ID NO: 19400 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aaaatggactgggctgcctc

SEQ ID NO: 19401 - DNA, 20 bp, Artificial Sequence
  Description of Artificial Sequence: Synthetic oligonucleotide
  Target: ATXN1; (+) strand; PAM type: NNGRRT; PAM sequence: AGGGAT
actgggctgcctcatgagtc

SEQ ID NO: 19402 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gcctcatgagtcagggatct

SEQ ID NO: 19403 - DNA, 20 bp, Artificial Sequence
  Description of Artificial Sequence: Synthetic oligonucleotide
  Target: ATXN1; (+) strand; PAM type: NNGRRT; PAM sequence: AAGGGT
agggatctctgggtcacccc

SEQ ID NO: 19404 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctctgggtcaccccaagggt

SEQ ID NO: 19405 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aagggtcaggatagaaactc

SEQ ID NO: 19406 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aggatagaaactcagggata

SEQ ID NO: 19407 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gaaactcagggatatggggt

SEQ ID NO: 19408 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ggtaggggtccctgccctgg

SEQ ID NO: 19409 - DNA, 20 bp, Artificial Sequence
  Description of Artificial Sequence: Synthetic oligonucleotide
  Target: ATXN1; (+) strand; PAM type: NNGRRT; PAM sequence: TCGGGT
agagcctcgccccaacgcgc

SEQ ID NO: 19410 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ggctctgcacccctgggaca

SEQ ID NO: 19411 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ttgctcttcacggaagtgta

SEQ ID NO: 19412 - DNA, 20 bp, Artificial Sequence
  Description of Artificial Sequence: Synthetic oligonucleotide
  Target: ATXN1; (+) strand; PAM type: NNGRRT; PAM sequence: AGGAGT
agctcgtaatccaagctaga

SEQ ID NO: 19413 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tatgtatcttaatttttatc

SEQ ID NO: 19414 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atcatgaataaggaaggaca

SEQ ID NO: 19415 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gaataaggaaggacagtggg

SEQ ID NO: 19416 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gttatgcccactcagaacct

SEQ ID NO: 19417 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ggaatggctttatttggaaa

SEQ ID NO: 19418 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gggtctttgcagatgtaatt

SEQ ID NO: 19419 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gatttggaaatgagatcatg

SEQ ID NO: 19420 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ggaggcagaggcagagagac

SEQ ID NO: 19421 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gaatgacgcagtcccaagcc

SEQ ID NO: 19422 - DNA, 20 bp, Artificial Sequence
  Description of Artificial Sequence: Synthetic oligonucleotide
  Target: ATXN1; (+) strand; PAM type: NNGRRT; PAM sequence: AGGAGT
attttagacttcaagcctcc

SEQ ID NO: 19423 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tcaagcctccaggagtgtta

SEQ ID NO: 19424 - DNA, 20 bp, Artificial Sequence
  Description of Artificial Sequence: Synthetic oligonucleotide
  Target: ATXN1; (+) strand; PAM type: NNGRRT; PAM sequence: GCGGGT
ttagtctacccaaccatgat

SEQ ID NO: 19425 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tttttcatgtagaaaaggga

SEQ ID NO: 19426 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agaaaagggacagaatgcac

SEQ ID NO: 19427 - DNA, 20 bp, Artificial Sequence
  Description of Artificial Sequence: Synthetic oligonucleotide
  Target: ATXN1; (+) strand; PAM type: NNGRRT; PAM sequence: CAGGAT
agtgaccaaggaagagaggt

SEQ ID NO: 19428 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ccaattgtgatccaggccat

SEQ ID NO: 19429 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gcaacctggcacaggctccc

SEQ ID NO: 19430 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ctttgaggcaagaccttcct

SEQ ID NO: 19431 - DNA, 20 bp, Artificial Sequence
  Description of Artificial Sequence: Synthetic oligonucleotide
  Target: ATXN1; (+) strand; PAM type: NNGRRT; PAM sequence: TTGGGT
caagaccttcctgggggtgg

SEQ ID NO: 19432 - DNA, 20 bp, Artificial Sequence
  Description of Artificial Sequence: Synthetic oligonucleotide
  Target: ATXN1; (+) strand; PAM type: NNGRRT; PAM sequence: GGGAAT
cctgggggtggttgggtcag

SEQ ID NO: 19433 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cactgccagctgggactgca

SEQ ID NO: 19434 - DNA, 20 bp, Artificial Sequence
  Description of Artificial Sequence: Synthetic oligonucleotide
  Target: ATXN1; (+) strand; PAM type: NNGRRT; PAM sequence: ACGAAT
ctacttatattatcagcacc

SEQ ID NO: 19435 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atctatagactttttgggca

SEQ ID NO: 19436 - DNA, 20 bp, Artificial Sequence
  Description of Artificial Sequence: Synthetic oligonucleotide
  Target: ATXN1; (+) strand; PAM type: NNGRRT; PAM sequence: TCGGGT
acccaaaataatagtctcat

SEQ ID NO: 19437 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tcattcgggtggtcgctggc

SEQ ID NO: 19438 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gggtagctctgcgtccagtg

SEQ ID NO: 19439 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gccttgaaggggaggctgga

SEQ ID NO: 19440 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tcccttatccctaagtgggg

SEQ ID NO: 19441 - DNA, 20 bp, Artificial Sequence
  Description of Artificial Sequence: Synthetic oligonucleotide
  Target: ATXN1; (+) strand; PAM type: NNGRRT; PAM sequence: GGGGGT
agtgagcagatgacagttct

SEQ ID NO: 19442 - DNA, 20 bp, Artificial Sequence
  Description of Artificial Sequence: Synthetic oligonucleotide
  Target: ATXN1; (+) strand; PAM type: NNGRRT; PAM sequence: TGGGGT
caggacatcggccatgtggc

SEQ ID NO: 19443 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gcacatgtccgtgagagctg

SEQ ID NO: 19444 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gtgagagctggaggatcagc

SEQ ID NO: 19445 - DNA, 20 bp, Artificial Sequence
  Description of Artificial Sequence: Synthetic oligonucleotide
  Target: ATXN1; (+) strand; PAM type: NNGRRT; PAM sequence: CGGAAT
ctctggcggcctgcccatgc

SEQ ID NO: 19446 - DNA, 20 bp, Artificial Sequence
  Description of Artificial Sequence: Synthetic oligonucleotide
  Target: ATXN1; (+) strand; PAM type: NNGRRT; PAM sequence: CTGGAT
caagatggaaaaataaccat

SEQ ID NO: 19447 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tggatccaagctggtcccaa

SEQ ID NO: 19448 - DNA, 20 bp, Artificial Sequence
  Description of Artificial Sequence: Synthetic oligonucleotide
  Target: ATXN1; (+) strand; PAM type: NNGRRT; PAM sequence: TTGAGT
aatgaattgtctgacagagg

SEQ ID NO: 19449 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttgtctgacagaggttgagt

SEQ ID NO: 19450 - DNA, 20 bp, Artificial Sequence
  Description of Artificial Sequence: Synthetic oligonucleotide
  Target: ATXN1; (+) strand; PAM type: NNGRRT; PAM sequence: TGGAGT
cagatgctttccacgctgcc

SEQ ID NO: 19451 - DNA, 20 bp, Artificial Sequence
  Description of Artificial Sequence: Synthetic oligonucleotide
  Target: ATXN1; (+) strand; PAM type: NNGRRT; PAM sequence: TGGGGT
caaggtaacacagtaagaac

SEQ ID NO: 19452 - DNA, 20 bp, Artificial Sequence
  Description of Artificial Sequence: Synthetic oligonucleotide
  Target: ATXN1; (+) strand; PAM type: NNGRRT; PAM sequence: GAGGAT
acagtaagaactggggtcag

SEQ ID NO: 19453 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cctgtcactttgactctcac

SEQ ID NO: 19454 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ttcacatccactgtcctatt

SEQ ID NO: 19455 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctattactactaaggacaca

SEQ ID NO: 19456 - DNA, 20 bp, Artificial Sequence
  Description of Artificial Sequence: Synthetic oligonucleotide
  Target: ATXN1; (+) strand; PAM type: NNGRRT; PAM sequence: TAGAGT
aggacacacagaattgtagt

SEQ ID NO: 19457 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttaggaggctgaggcgg

SEQ ID NO: 19458 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gtcaggagattgagaccatc

SEQ ID NO: 19459 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacgagggaggctaaggcag

SEQ ID NO: 19460 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tctctgcctttaaaatgggg

SEQ ID NO: 19461 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aattcaataaacatttcctc

SEQ ID NO: 19462 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tgatagaaaaagaggaagtg

SEQ ID NO: 19463 - DNA, 20 bp, Artificial Sequence
  Description of Artificial Sequence: Synthetic oligonucleotide
  Target: ATXN1; (+) strand; PAM type: NNGRRT; PAM sequence: GAGAGT
agaggaagtgatgggtgttt

SEQ ID NO: 19464 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ttttttcttcacttgatagg

SEQ ID NO: 19465 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aaggcaattcagcacacaag

SEQ ID NO: 19466 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aaagctcagacgctaaactc

SEQ ID NO: 19467 - DNA, 20 bp, Artificial Sequence
  Description of Artificial Sequence: Synthetic oligonucleotide
  Target: ATXN1; (+) strand; PAM type: NNGRRT; PAM sequence: AAGGGT
caaggatggcatttccaggg

SEQ ID NO: 19468 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ctgcttttccacaatacttt

SEQ ID NO: 19469 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ttttccacaatactttttgg

SEQ ID NO: 19470 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agacgcatggtggggaaatg

SEQ ID NO: 19471 - DNA, 20 bp, Artificial Sequence
  Description of Artificial Sequence: Synthetic oligonucleotide
  Target: ATXN1; (+) strand; PAM type: NNGRRT; PAM sequence: CTGGAT
actgctccaggaggcctagg

SEQ ID NO: 19472 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcctgccagccaccaggggg

SEQ ID NO: 19473 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tgggaactgaggtactctgg

SEQ ID NO: 19474 - DNA, 20 bp, Artificial Sequence
  Description of Artificial Sequence: Synthetic oligonucleotide
  Target: ATXN1; (+) strand; PAM type: NNGRRT; PAM sequence: CTGAAT
attcactgtccttggtgtgg

SEQ ID NO: 19475 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aagacaaggacattgaagct

SEQ ID NO: 19476 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aaaatcctaatatgaaaact

SEQ ID NO: 19477 - DNA, 20 bp, Artificial Sequence
  Description of Artificial Sequence: Synthetic oligonucleotide
  Target: ATXN1; (+) strand; PAM type: NNGRRT; PAM sequence: TTGGGT
gaaaacttgggatctagttc

SEQ ID NO: 19478 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tctagttcttgggttgtgta

SEQ ID NO: 19479 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tgggtcattagtgtgtagtg

SEQ ID NO: 19480 - DNA, 20 bp, Artificial Sequence
  Description of Artificial Sequence: Synthetic oligonucleotide
  Target: ATXN1; (+) strand; PAM type: NNGRRT; PAM sequence: CGGAGT
attttttttcttttttgaga

SEQ ID NO: 19481 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcactgcaacctctgcctc

SEQ ID NO: 19482 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttttgtatttttagtagaga

SEQ ID NO: 19483 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cagggtttcaccatgttggc

SEQ ID NO: 19484 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcggcctcccaaagtgc

SEQ ID NO: 19485 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agccaccgcgcctgaccatg

SEQ ID NO: 19486 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ggaggtgatctctcggcctc

SEQ ID NO: 19487 - DNA, 20 bp, Artificial Sequence
  Description of Artificial Sequence: Synthetic oligonucleotide
  Target: ATXN1; (+) strand; PAM type: NNGRRT; PAM sequence: CTGGAT
agaagtatgtttattggcca

SEQ ID NO: 19488 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tatgtttattggccactgga

SEQ ID NO: 19489 - DNA, 20 bp, Artificial Sequence
  Description of Artificial Sequence: Synthetic oligonucleotide
  Target: ATXN1; (+) strand; PAM type: NNGRRT; PAM sequence: ATGAGT
atcctttccctgtaataagt

SEQ ID NO: 19490 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tatgagtagaacagctttca

SEQ ID NO: 19491 - DNA, 20 bp, Artificial Sequence
  Description of Artificial Sequence: Synthetic oligonucleotide
  Target: ATXN1; (+) strand; PAM type: NNGRRT; PAM sequence: GTGAGT
aacagctttcagtgagttct

SEQ ID NO: 19492 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gagttctgtgagtcctttta

SEQ ID NO: 19493 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tttactgaattatcaaaacg

SEQ ID NO: 19494 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atccatcagcgttcagtgat

SEQ ID NO: 19495 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tgtggccagggaacaggcag

SEQ ID NO: 19496 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tgggtggtacagaaaggaac

SEQ ID NO: 19497 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gcacatacatgtaagaagca

SEQ ID NO: 19498 - DNA, 20 bp, Artificial Sequence
  Description of Artificial Sequence: Synthetic oligonucleotide
  Target: ATXN1; (+) strand; PAM type: NNGRRT; PAM sequence: GTGGAT
atacatgtaagaagcactga

SEQ ID NO: 19499 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gcactgagtggatcaatttt

SEQ ID NO: 19500 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gtggatcaatttttggggta

SEQ ID NO: 19501 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gtcttaatatcctcagccca

SEQ ID NO: 19502 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gacttactagaaatctacca

SEQ ID NO: 19503 - DNA, 20 bp, Artificial Sequence
  Description of Artificial Sequence: Synthetic oligonucleotide
  Target: ATXN1; (+) strand; PAM type: NNGRRT; PAM sequence: AGGAGT
catcccaacagaccaaatgg

SEQ ID NO: 19504 - DNA, 20 bp, Artificial Sequence
  Description of Artificial Sequence: Synthetic oligonucleotide
  Target: ATXN1; (+) strand; PAM type: NNGRRT; PAM sequence: GAGGAT
atttcctccacaatacaaag

SEQ ID NO: 19505 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tcactgtgtttgtggtcatg

SEQ ID NO: 19506 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gggccatactctctcacctg

SEQ ID NO: 19507 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ccagatctaccccagaccaa

SEQ ID NO: 19508 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctaccccagaccaactgaat

SEQ ID NO: 19509 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gcattttaggaaatgcacca

SEQ ID NO: 19510 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aggtgagaacctctggtata

SEQ ID NO: 19511 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttttttttttttttttgaga

SEQ ID NO: 19512 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tctcgctctgtcccccaggc

SEQ ID NO: 19513 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ctcactgcaagctccacctc

SEQ ID NO: 19514 - DNA, 20 bp, Artificial Sequence
  Description of Artificial Sequence: Synthetic oligonucleotide
  Target: ATXN1; (+) strand; PAM type: NNGRRT; PAM sequence: CCGAGT
cattctcctgcctcagcctc

SEQ ID NO: 19515 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtagaga

SEQ ID NO: 19516 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tggggtttcaccgtgttagc

SEQ ID NO: 19517 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcggcctcccaaagtac

SEQ ID NO: 19518 - DNA, 20 bp, Artificial Sequence
  Description of Artificial Sequence: Synthetic oligonucleotide
  Target: ATXN1; (+) strand; PAM type: NNGRRT; PAM sequence: GAGGAT
caccgcacccggctggtata

SEQ ID NO: 19519 - DNA, 20 bp, Artificial Sequence
  Description of Artificial Sequence: Synthetic oligonucleotide
  Target: ATXN1; (+) strand; PAM type: NNGRRT; PAM sequence: CGGAGT
ttttttttttttttttgaga

SEQ ID NO: 19520 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gtcacccaggctggtgtgca

SEQ ID NO: 19521 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaagtagt

SEQ ID NO: 19522 - DNA, 20 bp, Artificial Sequence
  Description of Artificial Sequence: Synthetic oligonucleotide
  Target: ATXN1; (+) strand; PAM type: NNGRRT; PAM sequence: CGGGGT
atttttatttttggtagaga

SEQ ID NO: 19523 - DNA, 20 bp, Artificial Sequence
  Description of Artificial Sequence: Synthetic oligonucleotide
  Target: ATXN1; (+) strand; PAM type: NNGRRT; PAM sequence: TGGGAT
accttggcctcccaacgtgc

SEQ ID NO: 19524 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gttcctcaaaatgtgaaata

SEQ ID NO: 19525 - DNA, 20 bp, Artificial Sequence
  Description of Artificial Sequence: Synthetic oligonucleotide
  Target: ATXN1; (+) strand; PAM type: NNGRRT; PAM sequence: CTGGAT
atgactcagcaattccacgt

SEQ ID NO: 19526 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aacccaatgatcatcaacag

SEQ ID NO: 19527 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tcatccccctctccttacaa

SEQ ID NO: 19528 - DNA, 20 bp, Artificial Sequence
  Description of Artificial Sequence: Synthetic oligonucleotide
  Target: ATXN1; (+) strand; PAM type: NNGRRT; PAM sequence: AGGAAT
catatgattccccttctatg

SEQ ID NO: 19529 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ttccccttctatgaggaatc

SEQ ID NO: 19530 - DNA, 20 bp, Artificial Sequence
  Description of Artificial Sequence: Synthetic oligonucleotide
  Target: ATXN1; (+) strand; PAM type: NNGRRT; PAM sequence: GGGAGT
agctgggaggacggggcaat

SEQ ID NO: 19531 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tgggagttgtttaacggttc

SEQ ID NO: 19532 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gatggtggtgatggttgaac

SEQ ID NO: 19533 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgagaggctgagacag

SEQ ID NO: 19534 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcgcaccactgcactccagc

SEQ ID NO: 19535 - DNA, 20 bp, Artificial Sequence
  Description of Artificial Sequence: Synthetic oligonucleotide
  Target: ATXN1; (+) strand; PAM type: NNGRRT; PAM sequence: AAGGAT
cctcatctgcttggagctac

SEQ ID NO: 19536 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ggttatgtcagttccaccct

SEQ ID NO: 19537 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ccacagataatttgtaacca

SEQ ID NO: 19538 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ataatttgtaaccagtgggt

SEQ ID NO: 19539 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aatatgcctgctgcaggcct

SEQ ID NO: 19540 - DNA, 20 bp, Artificial Sequence
  Description of Artificial Sequence: Synthetic oligonucleotide
  Target: ATXN1; (+) strand; PAM type: NNGRRT; PAM sequence: TAGAGT
atgtgttccctctgctctgt

SEQ ID NO: 19541 - DNA, 20 bp, Artificial Sequence
  Description of Artificial Sequence: Synthetic oligonucleotide
  Target: ATXN1; (+) strand; PAM type: NNGRRT; PAM sequence: CGGAGT
gcgtgcgcatcacattcacc

SEQ ID NO: 19542 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ggtgggcatgatggttaata

SEQ ID NO: 19543 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aatactgagtgtcaacttga

SEQ ID NO: 19544 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gtgtcaacttgattggattg

SEQ ID NO: 19545 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ttattcttggttgtgtctgt

SEQ ID NO: 19546 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ttgccaaaggagataaacat

SEQ ID NO: 19547 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gaggaagacccaccctcaat

SEQ ID NO: 19548 - DNA, 20 bp, Artificial Sequence
  Description of Artificial Sequence: Synthetic oligonucleotide
  Target: ATXN1; (+) strand; PAM type: NNGRRT; PAM sequence: TAGAAT
taatcagctgccagtgaggc

SEQ ID NO: 19549 - DNA, 20 bp, Artificial Sequence
  Description of Artificial Sequence: Synthetic oligonucleotide
  Target: ATXN1; (+) strand; PAM type: NNGRRT; PAM sequence: CTGAGT
acgtagaaggactagactgg

SEQ ID NO: 19550 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gccttcatctttttctcgtg

SEQ ID NO: 19551 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ggacttgaccttttgatcat

SEQ ID NO: 19552 - DNA, 20 bp, Artificial Sequence
  Description of Artificial Sequence: Synthetic oligonucleotide
  Target: ATXN1; (+) strand; PAM type: NNGRRT; PAM sequence: GTGGGT
agagaaccctgactaataca

SEQ ID NO: 19553 - DNA, 20 bp, Artificial Sequence
  Description of Artificial Sequence: Synthetic oligonucleotide
  Target: ATXN1; (+) strand; PAM type: NNGRRT; PAM sequence: TTGGGT
agactgaagttcacaacccc

SEQ ID NO: 19554 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ttcacaaccccttgggtttc

SEQ ID NO: 19555 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aagctggttattaaaaggca

SEQ ID NO: 19556 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tattaaaaggcaaaggattt

SEQ ID NO: 19557 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tctggatcattttctagatt

SEQ ID NO: 19558 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ataatgttgtggtatctgca

SEQ ID NO: 19559 - DNA, 20 bp, Artificial Sequence
  Description of Artificial Sequence: Synthetic oligonucleotide
  Target: ATXN1; (+) strand; PAM type: NNGRRT; PAM sequence: TCGGGT
ttattaactcctgttacttc

SEQ ID NO: 19560 - DNA, 20 bp, Artificial Sequence
  Description of Artificial Sequence: Synthetic oligonucleotide
  Target: ATXN1; (+) strand; PAM type: NNGRRT; PAM sequence: CTGGAT
aggaaacacctcggtagtct

SEQ ID NO: 19561 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctgtacacatcggccaagat

SEQ ID NO: 19562 - DNA, 20 bp, Artificial Sequence
  Description of Artificial Sequence: Synthetic oligonucleotide
  Target: ATXN1; (+) strand; PAM type: NNGRRT; PAM sequence: AGGGGT
taaatgtttgttttaaaatt

SEQ ID NO: 19563 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aggggtatgactcacactcg

SEQ ID NO: 19564 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gtatgactcacactcggtga

SEQ ID NO: 19565 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgacttctgaccctcaaaag

SEQ ID NO: 19566 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctttctacctccactgactt

SEQ ID NO: 19567 - DNA, 20 bp, Artificial Sequence
  Description of Artificial Sequence: Synthetic oligonucleotide
  Target: ATXN1; (+) strand; PAM type: NNGRRT; PAM sequence: CCGAGT
tagtggagcccaagatggcc

SEQ ID NO: 19568 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gtcactagcaagatggacaa

SEQ ID NO: 19569 - DNA, 20 bp, Artificial Sequence
  Description of Artificial Sequence: Synthetic oligonucleotide
  Target: ATXN1; (+) strand; PAM type: NNGRRT; PAM sequence: CTGAGT
agctgttttcaataaaaaag

SEQ ID NO: 19570 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ccaatggaacattaaggaca

SEQ ID NO: 19571 - DNA, 20 bp, Artificial Sequence
  Description of Artificial Sequence: Synthetic oligonucleotide
  Target: ATXN1; (+) strand; PAM type: NNGRRT; PAM sequence: CTGGAT
taaaaaaaaattgacactcc

SEQ ID NO: 19572 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctggatgtaggcaacaccct

SEQ ID NO: 19573 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcactgcaacctccgcctc

SEQ ID NO: 19574 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gattctcatgcctcagcctc

SEQ ID NO: 19575 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcctgagtagc

SEQ ID NO: 19576 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gtttttgtacttttttcaga

SEQ ID NO: 19577 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ccatctcggcctcccaaagt

SEQ ID NO: 19578 - DNA, 20 bp, Artificial Sequence
  Description of Artificial Sequence: Synthetic oligonucleotide
  Target: ATXN1; (+) strand; PAM type: NNGRRT; PAM sequence: TGGGAT
agtgggagtgagccaccgct

SEQ ID NO: 19579 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aatttaggggctgggaagat

SEQ ID NO: 19580 - DNA, 20 bp, Artificial Sequence
  Description of Artificial Sequence: Synthetic oligonucleotide
  Target: ATXN1; (+) strand; PAM type: NNGRRT; PAM sequence: CCGGGT
tctctccctcttttttgtcg

SEQ ID NO: 19581 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcacccaggc

SEQ ID NO: 19582 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ggaggtgtggaaggagaggc

SEQ ID NO: 19583 - DNA, 20 bp, Artificial Sequence
  Description of Artificial Sequence: Synthetic oligonucleotide
  Target: ATXN1; (+) strand; PAM type: NNGRRT; PAM sequence: AGGAGT
catcgaccacccaaggactg

SEQ ID NO: 19584 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aggtgaagccagctgggctc

SEQ ID NO: 19585 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agaacctttatgtctagcta

SEQ ID NO: 19586 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tcagcaccctgtgtctagct

SEQ ID NO: 19587 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ctgtgtctagctcagggttt

SEQ ID NO: 19588 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agaacctttatgtctagcta

SEQ ID NO: 19589 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tcagcaccctgtgtctagct

SEQ ID NO: 19590 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ctgtgtctagctcagggttt

SEQ ID NO: 19591 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agaacctttgtgtctagctc

SEQ ID NO: 19592 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aatggaccaatcagcagaac

SEQ ID NO: 19593 - DNA, 20 bp, Artificial Sequence
  Description of Artificial Sequence: Synthetic oligonucleotide
  Target: ATXN1; (+) strand; PAM type: NNGRRT; PAM sequence: GAGAAT
acatgggtagggccagataa

SEQ ID NO: 19594 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ttgctgctgctgttcactct

SEQ ID NO: 19595 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gagaccatgaacccacaggg

SEQ ID NO: 19596 - DNA, 20 bp, Artificial Sequence
  Description of Artificial Sequence: Synthetic oligonucleotide
  Target: ATXN1; (+) strand; PAM type: NNGRRT; PAM sequence: AAGGGT
agaactgtaacactcaccgc

SEQ ID NO: 19597 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tcctcagcttccttagtagc

SEQ ID NO: 19598 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tttaaacttttttattcaga

SEQ ID NO: 19599 - DNA, 20 bp, Artificial Sequence
  Description of Artificial Sequence: Synthetic oligonucleotide
  Target: ATXN1; (+) strand; PAM type: NNGRRT; PAM sequence: TAGAAT
attttggctttccatagtgt

SEQ ID NO: 19600 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ggggcagatcatgtgagatc

SEQ ID NO: 19601 - DNA, 20 bp, Artificial Sequence
  Description of Artificial Sequence: Synthetic oligonucleotide
  Target: ATXN1; (+) strand; PAM type: NNGRRT; PAM sequence: GTGAGT
aaaattagccgggcttggtg

SEQ ID NO: 19602 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttccagggaggctgaggcag

SEQ ID NO: 19603 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgcactctagcctgggcgac

SEQ ID NO: 19604 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ttatttcatgaagttgttat

SEQ ID NO: 19605 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tgcagcaaacagcacaggcc

SEQ ID NO: 19606 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gggatctaggccacctgatt

SEQ ID NO: 19607 - DNA, 20 bp, Artificial Sequence
  Description of Artificial Sequence: Synthetic oligonucleotide
  Target: ATXN1; (+) strand; PAM type: NNGRRT; PAM sequence: GGGAAT
agtttgctcatctccaaagt

SEQ ID NO: 19608 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tcctaccccacaggcttgct

SEQ ID NO: 19609 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gctgtgagttcacacataag

SEQ ID NO: 19610 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggctgaggctg

SEQ ID NO: 19611 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tactcgggaggctgaggcag

SEQ ID NO: 19612 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aaaaaacacattttcctccc

SEQ ID NO: 19613 - DNA, 20 bp, Artificial Sequence
  Description of Artificial Sequence: Synthetic oligonucleotide
  Target: ATXN1; (+) strand; PAM type: NNGRRT; PAM sequence: GTGAAT
agtcagctccagcaaagatg

SEQ ID NO: 19614 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gctccagcaaagatggtgaa

SEQ ID NO: 19615 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aaatcaatgcttttcctttt

SEQ ID NO: 19616 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ttagaataccatgccctaac

SEQ ID NO: 19617 - DNA, 20 bp, Artificial Sequence
  Description of Artificial Sequence: Synthetic oligonucleotide
  Target: ATXN1; (+) strand; PAM type: NNGRRT; PAM sequence: TGGAAT
taagcctcagtttcctcatc

SEQ ID NO: 19618 - DNA, 20 bp, Artificial Sequence
  Description of Artificial Sequence: Synthetic oligonucleotide
  Target: ATXN1; (+) strand; PAM type: NNGRRT; PAM sequence: GTGAAT
agtttcctcatctggaatat

SEQ ID NO: 19619 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctgaacttcagtctcagctc

SEQ ID NO: 19620 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tctcagctcaagagtctgtg

SEQ ID NO: 19621 - DNA, 20 bp, Artificial Sequence
  Description of Artificial Sequence: Synthetic oligonucleotide
  Target: ATXN1; (+) strand; PAM type: NNGRRT; PAM sequence: TTGGAT
agtctgtgaggaatttccac

SEQ ID NO: 19622 - DNA, 20 bp, Artificial Sequence
  Description of Artificial Sequence: Synthetic oligonucleotide
  Target: ATXN1; (+) strand; PAM type: NNGRRT; PAM sequence: TGGGGT
cttcaaaatgtctcaactct

SEQ ID NO: 19623 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cccatatttactgtgtagga

SEQ ID NO: 19624 - DNA, 20 bp, Artificial Sequence
  Description of Artificial Sequence: Synthetic oligonucleotide
  Target: ATXN1; (+) strand; PAM type: NNGRRT; PAM sequence: ACGGGT
gaatttggctttggccaaag

SEQ ID NO: 19625 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gtccctatttgtggggaggg

SEQ ID NO: 19626 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tggtttcctcattttaaaat

SEQ ID NO: 19627 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cattttaaaatgggaattgg

SEQ ID NO: 19628 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caggaggactatgtgaggcc

SEQ ID NO: 19629 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gccaggaattcgagaccagc

SEQ ID NO: 19630 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aacttgggaggctgaggtgg

SEQ ID NO: 19631 - DNA, 20 bp, Artificial Sequence
  Description of Artificial Sequence: Synthetic oligonucleotide
  Target: ATXN1; (+) strand; PAM type: NNGRRT; PAM sequence: CAGGGT
agataataacacgtacccta

SEQ ID NO: 19632 - DNA, 20 bp, Artificial Sequence
  Description of Artificial Sequence: Synthetic oligonucleotide
  Target: ATXN1; (+) strand; PAM type: NNGRRT; PAM sequence: TAGGGT
taacacgtaccctacagggt

SEQ ID NO: 19633 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gaacatgaaggaaatgggca

SEQ ID NO: 19634 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aaatgggcagaggattccag

SEQ ID NO: 19635 - DNA, 20 bp, Artificial Sequence
  Description of Artificial Sequence: Synthetic oligonucleotide
  Target: ATXN1; (+) strand; PAM type: NNGRRT; PAM sequence: TTGAGT
agagcatttccattttcatt

SEQ ID NO: 19636 - DNA, 20 bp, Artificial Sequence
  Description of Artificial Sequence: Synthetic oligonucleotide
  Target: ATXN1; (+) strand; PAM type: NNGRRT; PAM sequence: GTGAAT
agaaaccaatttttccccca

SEQ ID NO: 19637 - DNA, 20 bp, Artificial Sequence
  Description of Artificial Sequence: Synthetic oligonucleotide
  Target: ATXN1; (+) strand; PAM type: NNGRRT; PAM sequence: CAGGGT
agtgaatgtttttttaattt

SEQ ID NO: 19638 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcatacaggc

SEQ ID NO: 19639 - DNA, 20 bp, Artificial Sequence
  Description of Artificial Sequence: Synthetic oligonucleotide
  Target: ATXN1; (+) strand; PAM type: NNGRRT; PAM sequence: TTGAGT
catccacccacctctgcctc

SEQ ID NO: 19640 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttttgtagtttttgtagaga

SEQ ID NO: 19641 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gtctcagcctcccaaagtgt

SEQ ID NO: 19642 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ctaccacacccagcccattc

SEQ ID NO: 19643 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ccagcccattcttgagtatg

SEQ ID NO: 19644 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ggtctttcacagcatttact

SEQ ID NO: 19645 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ggcttccatcagaaaaacat

SEQ ID NO: 19646 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tcaggacacgttccagaaac

SEQ ID NO: 19647 - DNA, 20 bp, Artificial Sequence
  Description of Artificial Sequence: Synthetic oligonucleotide
  Target: ATXN1; (+) strand; PAM type: NNGRRT; PAM sequence: GCGAAT
tttttccctgctatagtttc

SEQ ID NO: 19648 - DNA, 20 bp, Artificial Sequence
  Description of Artificial Sequence: Synthetic oligonucleotide
  Target: ATXN1; (+) strand; PAM type: NNGRRT; PAM sequence: AGGGAT
attttgctctggttaaccca

SEQ ID NO: 19649 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tctggttaacccaagggatg

SEQ ID NO: 19650 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ttaacccaagggatggtggg

SEQ ID NO: 19651 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aagcagcaataaggcagtga

SEQ ID NO: 19652 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gagcctgaagggaccagcca

SEQ ID NO: 19653 - DNA, 20 bp, Artificial Sequence
  Description of Artificial Sequence: Synthetic oligonucleotide
  Target: ATXN1; (+) strand; PAM type: NNGRRT; PAM sequence: ATGAGT
caagccaggaacagccaggc

SEQ ID NO: 19654 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aggcatgagtaatgccttag

SEQ ID NO: 19655 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atgagtaatgccttagatgg

SEQ ID NO: 19656 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ataatgttttaacaaaacgc

SEQ ID NO: 19657 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tctccacatctcaggctggg

SEQ ID NO: 19658 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gaaggaaatgatcacagcaa

SEQ ID NO: 19659 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gctcaaaagaagcatcatgg

SEQ ID NO: 19660 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tagtccccgccttatccatg

SEQ ID NO: 19661 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aataggttccaagaccccca

SEQ ID NO: 19662 - DNA, 20 bp, Artificial Sequence
  Description of Artificial Sequence: Synthetic oligonucleotide
  Target: ATXN1; (+) strand; PAM type: NNGRRT; PAM sequence: CTGGAT
cagtgggttcctgaaaccca

SEQ ID NO: 19663 - DNA, 20 bp, Artificial Sequence
  Description of Artificial Sequence: Synthetic oligonucleotide
  Target: ATXN1; (+) strand; PAM type: NNGRRT; PAM sequence: GTGGAT
agcacttccatcccaccaca

SEQ ID NO: 19664 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gggacgattcacgtctgcgt

SEQ ID NO: 19665 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gattcacgtctgcgttagga

SEQ ID NO: 19666 - DNA, 20 bp, Artificial Sequence
  Description of Artificial Sequence: Synthetic oligonucleotide
  Target: ATXN1; (+) strand; PAM type: NNGRRT; PAM sequence: TGGAAT
acttaggaactgtttatttc

SEQ ID NO: 19667 - DNA, 20 bp, Artificial Sequence
  Description of Artificial Sequence: Synthetic oligonucleotide
  Target: ATXN1; (+) strand; PAM type: NNGRRT; PAM sequence: GCGGAT
ttggcctcagaaatcaacct

SEQ ID NO: 19668 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gcagaaaggaaaagcgctca

SEQ ID NO: 19669 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ggaaaagcgctcatagaatg

SEQ ID NO: 19670 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggctgaggtgg

SEQ ID NO: 19671 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aggctgaggtgggcggatct

SEQ ID NO: 19672 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggtgggcggatcttggggtc

SEQ ID NO: 19673 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcat

SEQ ID NO: 19674 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgaaaaacagcttcgtctac

SEQ ID NO: 19675 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gtgcatgaggacattacagt

SEQ ID NO: 19676 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gacattacagtgagggtccc

SEQ ID NO: 19677 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtaggtctgggctgggacct

SEQ ID NO: 19678 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tcttaaccttggcagcacag

SEQ ID NO: 19679 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gccactgaactcagaaccta

SEQ ID NO: 19680 - DNA, 20 bp, Artificial Sequence
  Description of Artificial Sequence: Synthetic oligonucleotide
  Target: ATXN1; (+) strand; PAM type: NNGRRT; PAM sequence: CGGAGT
gaactcagaacctatagggt

SEQ ID NO: 19681 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tcagaacctatagggtcgga

SEQ ID NO: 19682 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ttcaatgtgcagccatggtt

SEQ ID NO: 19683 - DNA, 20 bp, Artificial Sequence
  Description of Artificial Sequence: Synthetic oligonucleotide
  Target: ATXN1; (+) strand; PAM type: NNGRRT; PAM sequence: TGGAGT
acttatttttttttttgaga

SEQ ID NO: 19684 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcgctctgtcgcccaggc

SEQ ID NO: 19685 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcactgcaacctctgcctc

SEQ ID NO: 19686 - DNA, 20 bp, Artificial Sequence
  Description of Artificial Sequence: Synthetic oligonucleotide
  Target: ATXN1; (+) strand; PAM type: NNGRRT; PAM sequence: CGGGAT
ttttgtatttttagtagaga

SEQ ID NO: 19687 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cgggatttcactgtgttagc

SEQ ID NO: 19688 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gcctcagcctcccaaagtgt

SEQ ID NO: 19689 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gacccttctattttataaag

SEQ ID NO: 19690 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttataaagctgggttacaca

SEQ ID NO: 19691 - DNA, 20 bp, Artificial Sequence
  Description of Artificial Sequence: Synthetic oligonucleotide
  Target: ATXN1; (+) strand; PAM type: NNGRRT; PAM sequence: TCGAGT
gcttttcccagaaaacaaaa

SEQ ID NO: 19692 - DNA, 20 bp, Artificial Sequence
  Description of Artificial Sequence: Synthetic oligonucleotide
  Target: ATXN1; (+) strand; PAM type: NNGRRT; PAM sequence: GAGGAT
acaaagtttttagatattta

SEQ ID NO: 19693 - DNA, 20 bp, Artificial Sequence
  Description of Artificial Sequence: Synthetic oligonucleotide
  Target: ATXN1; (+) strand; PAM type: NNGRRT; PAM sequence: AGGGGT
atataattatctacactttg

SEQ ID NO: 19694 - DNA, 20 bp, Artificial Sequence
  Description of Artificial Sequence: Synthetic oligonucleotide
  Target: ATXN1; (+) strand; PAM type: NNGRRT; PAM sequence: CTGGGT
acaggtgcctgacatcctct

SEQ ID NO: 19695 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ggttgttcttctgatttgtg

SEQ ID NO: 19696 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgatatgcaagaaactcta

SEQ ID NO: 19697 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tgctgagagcagaacccagc

SEQ ID NO: 19698 - DNA, 20 bp, Artificial Sequence
  Description of Artificial Sequence: Synthetic oligonucleotide
  Target: ATXN1; (+) strand; PAM type: NNGRRT; PAM sequence: AGGAAT
attttacggaaaactgcagc

SEQ ID NO: 19699 - DNA, 20 bp, Artificial Sequence
  Description of Artificial Sequence: Synthetic oligonucleotide
  Target: ATXN1; (+) strand; PAM type: NNGRRT; PAM sequence: ATGGAT
caagagcagtgtcgaccctg

SEQ ID NO: 19700 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ggtgggggaggagaagcccc

SEQ ID NO: 19701 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agaagccccatggataagaa

SEQ ID NO: 19702 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctcaatcttccccttcctgc

SEQ ID NO: 19703 - DNA, 20 bp, Artificial Sequence
  Description of Artificial Sequence: Synthetic oligonucleotide
  Target: ATXN1; (+) strand; PAM type: NNGRRT; PAM sequence: CGGAGT
tttttttttcttttttgaga

SEQ ID NO: 19704 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aattctcctgcctcagcctc

SEQ ID NO: 19705 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcctgagtagc

SEQ ID NO: 19706 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttttctatttttagtagaga

SEQ ID NO: 19707 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ccgtattggcaaggctggtc

SEQ ID NO: 19708 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gccttggcctcccaaagtgc

SEQ ID NO: 19709 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttagcaaataaagcaaatgt

SEQ ID NO: 19710 - DNA, 20 bp, Artificial Sequence
  Description of Artificial Sequence: Synthetic oligonucleotide
  Target: ATXN1; (+) strand; PAM type: NNGRRT; PAM sequence: ACGGAT
aaaaaatcgtggcacaggtc

SEQ ID NO: 19711 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ggttccactgctgtctcaca

SEQ ID NO: 19712 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gaacagggctgtatttaatt

SEQ ID NO: 19713 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tttgctgttggcaatgttat

SEQ ID NO: 19714 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gcaatgttatgggaatagta

SEQ ID NO: 19715 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gtaatgaatttttgctttcc

SEQ ID NO: 19716 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctttccatgaataaattttt

SEQ ID NO: 19717 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttccttggaagggaagtaga

SEQ ID NO: 19718 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tataacttatgcagaccacc

SEQ ID NO: 19719 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgtcaaacatttttaggaag

SEQ ID NO: 19720 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gagatctagattgggaaagc

SEQ ID NO: 19721 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ccaagaaacccaaatctata

SEQ ID NO: 19722 - DNA, 20 bp, Artificial Sequence
  Description of Artificial Sequence: Synthetic oligonucleotide
  Target: ATXN1; (+) strand; PAM type: NNGRRT; PAM sequence: ATGGGT
atatgcactactaaggtcct

SEQ ID NO: 19723 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcacccaggc

SEQ ID NO: 19724 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ctcactgcaacctctgcctc

SEQ ID NO: 19725 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ggttcttctgcctcagcctc

SEQ ID NO: 19726 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acatcggcctcccaaagtgc

SEQ ID NO: 19727 - DNA, 20 bp, Artificial Sequence
  Description of Artificial Sequence: Synthetic oligonucleotide
  Target: ATXN1; (+) strand; PAM type: NNGRRT; PAM sequence: CCGAGT
cattttaattaaatgcttaa

SEQ ID NO: 19728 - DNA, 20 bp, Artificial Sequence
  Description of Artificial Sequence: Synthetic oligonucleotide
  Target: ATXN1; (+) strand; PAM type: NNGRRT; PAM sequence: CAGAAT
attaaatgcttaaccgagtc

SEQ ID NO: 19729 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tccaatcagctcagttccca

SEQ ID NO: 19730 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caaaaaattggcaaggctcg

SEQ ID NO: 19731 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cgaggaatgattgatggaag

SEQ ID NO: 19732 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tggaagctgggttgaaccaa

SEQ ID NO: 19733 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aggagtgggagctctcaggt

SEQ ID NO: 19734 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tacaactgcaataagataca

SEQ ID NO: 19735 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aataagatacacagaatgga

SEQ ID NO: 19736 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ggaactctcctgaaaggacc

SEQ ID NO: 19737 - DNA, 20 bp, Artificial Sequence
  Description of Artificial Sequence: Synthetic oligonucleotide
  Target: ATXN1; (+) strand; PAM type: NNGRRT; PAM sequence: CGGGGT
accaagagtaggtaagggaa

SEQ ID NO: 19738 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aaaaaatgatagatattgat

SEQ ID NO: 19739 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aacacttttacattgctggt

SEQ ID NO: 19740 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttgatccaacaatcccacta

SEQ ID NO: 19741 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gcccaaatgcccatcaatca

SEQ ID NO: 19742 - DNA, 20 bp, Artificial Sequence
  Description of Artificial Sequence: Synthetic oligonucleotide
  Target: ATXN1; (+) strand; PAM type: NNGRRT; PAM sequence: GTGGAT
aaatgcccatcaatcaatga

SEQ ID NO: 19743 - DNA, 20 bp, Artificial Sequence
  Description of Artificial Sequence: Synthetic oligonucleotide
  Target: ATXN1; (+) strand; PAM type: NNGRRT; PAM sequence: CAGAAT
attattgtatgtatatatca

SEQ ID NO: 19744 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tcacagcaacctgtttggaa

SEQ ID NO: 19745 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tattctaagtgaagtaactc

SEQ ID NO: 19746 - DNA, 20 bp, Artificial Sequence
  Description of Artificial Sequence: Synthetic oligonucleotide
  Target: ATXN1; (+) strand; PAM type: NNGRRT; PAM sequence: CCGAGT
tggtggcagccctgttcatt

SEQ ID NO: 19747 - DNA, 20 bp, Artificial Sequence
  Description of Artificial Sequence: Synthetic oligonucleotide
  Target: ATXN1; (+) strand; PAM type: NNGRRT; PAM sequence: TGGGAT
cagccctgttcattccgagt

SEQ ID NO: 19748 - DNA, 20 bp, Artificial Sequence
  Description of Artificial Sequence: Synthetic oligonucleotide
  Target: ATXN1; (+) strand; PAM type: NNGRRT; PAM sequence: CCGAGT
cccaaactgcagctgtagat

SEQ ID NO: 19749 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ttgggggagcctggaacagg

SEQ ID NO: 19750 - DNA, 20 bp, Artificial Sequence
  Description of Artificial Sequence: Synthetic oligonucleotide
  Target: ATXN1; (+) strand; PAM type: NNGRRT; PAM sequence: CCGAGT
aagcgggagccctgcccctt

SEQ ID NO: 19751 - DNA, 20 bp, Artificial Sequence
  Description of Artificial Sequence: Synthetic oligonucleotide
  Target: ATXN1; (+) strand; PAM type: NNGRRT; PAM sequence: CCGGGT
agttgtcagggcgggagctc

SEQ ID NO: 19752 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cacccactcagatctcagag

SEQ ID NO: 19753 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tggggccaagccccggggcc

SEQ ID NO: 19754 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gaatggcagcaggaggaaga

SEQ ID NO: 19755 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gggtccggggcagaaaagag

SEQ ID NO: 19756 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gggctgccagtcctgccgac

SEQ ID NO: 19757 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ggcttagccacagcaggcag

SEQ ID NO: 19758 - DNA, 20 bp, Artificial Sequence
  Description of Artificial Sequence: Synthetic oligonucleotide
  Target: ATXN1; (+) strand; PAM type: NNGRRT; PAM sequence: GAGAAT
agggacaaagggggcagaga

SEQ ID NO: 19759 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ggggcagagagagaatggga

SEQ ID NO: 19760 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ctggatgaccagttgcagag

SEQ ID NO: 19761 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gagctaccctctctgctaag

SEQ ID NO: 19762 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aggagtgcttcagagacctg

SEQ ID NO: 19763 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gagaggagctccccactcct

SEQ ID NO: 19764 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ataagtgggagccaagccat

SEQ ID NO: 19765 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gactttggggacttgggaga

SEQ ID NO: 19766 - DNA, 20 bp, Artificial Sequence
  Description of Artificial Sequence: Synthetic oligonucleotide
  Target: ATXN1; (+) strand; PAM type: NNGRRT; PAM sequence: GGGGGT
cttgggagaaagggtgggag

SEQ ID NO: 19767 - DNA, 20 bp, Artificial Sequence
  Description of Artificial Sequence: Synthetic oligonucleotide
  Target: ATXN1; (+) strand; PAM type: NNGRRT; PAM sequence: AGGGAT
gaaagggtgggaggggggtg

SEQ ID NO: 19768 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gagggataaatgactacaaa

SEQ ID NO: 19769 - DNA, 20 bp, Artificial Sequence
  Description of Artificial Sequence: Synthetic oligonucleotide
  Target: ATXN1; (+) strand; PAM type: NNGRRT; PAM sequence: TCGGGT
atgggtacagtgtatagtgc

SEQ ID NO: 19770 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agcagagaaacagaaagact

SEQ ID NO: 19771 - DNA, 20 bp, Artificial Sequence
  Description of Artificial Sequence: Synthetic oligonucleotide
  Target: ATXN1; (+) strand; PAM type: NNGRRT; PAM sequence: TTGGAT
agaaagactaagaatggcca

SEQ ID NO: 19772 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aatggccattggattagacc

SEQ ID NO: 19773 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ccatgggttctcaatatctg

SEQ ID NO: 19774 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gcttctacaagacactaacc

SEQ ID NO: 19775 - DNA, 20 bp, Artificial Sequence
  Description of Artificial Sequence: Synthetic oligonucleotide
  Target: ATXN1; (+) strand; PAM type: NNGRRT; PAM sequence: CTGAAT
acaagacactaacccagaat

SEQ ID NO: 19776 - DNA, 20 bp, Artificial Sequence
  Description of Artificial Sequence: Synthetic oligonucleotide
  Target: ATXN1; (+) strand; PAM type: NNGRRT; PAM sequence: CTGGAT
agaatctgaattaatgccca

SEQ ID NO: 19777 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gtcaatgggaaataatgtgc

SEQ ID NO: 19778 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcatttgaacatctcatgcc

SEQ ID NO: 19779 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ccacatcacgaagcaaatgc

SEQ ID NO: 19780 - DNA, 20 bp, Artificial Sequence
  Description of Artificial Sequence: Synthetic oligonucleotide
  Target: ATXN1; (+) strand; PAM type: NNGRRT; PAM sequence: ACGGGT
tcttgtttgctccctcttca

SEQ ID NO: 19781 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ccattatcccaatacaccac

SEQ ID NO: 19782 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tctttccctgtattcaggaa

SEQ ID NO: 19783 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aacagccctgtccatttgta

SEQ ID NO: 19784 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gctaatgaaaatgctcaata

SEQ ID NO: 19785 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aatatgtctgagcccctatg

SEQ ID NO: 19786 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aactgtctctgagaggcaag

SEQ ID NO: 19787 - DNA, 20 bp, Artificial Sequence
  Description of Artificial Sequence: Synthetic oligonucleotide
  Target: ATXN1; (+) strand; PAM type: NNGRRT; PAM sequence: AGGGGT
aggcaagaagaatctgtgtt

SEQ ID NO: 19788 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gacattaaattcatagccaa

SEQ ID NO: 19789 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tagtgattattacaaaattc

SEQ ID NO: 19790 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ttacaaaattcaggggtaac

SEQ ID NO: 19791 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aagggtgaaagagaaaagag

SEQ ID NO: 19792 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ttcacattctgtttctgaaa

SEQ ID NO: 19793 - DNA, 20 bp, Artificial Sequence
  Description of Artificial Sequence: Synthetic oligonucleotide
  Target: ATXN1; (+) strand; PAM type: NNGRRT; PAM sequence: ATGGAT
cagccttgaggaaatatctg

SEQ ID NO: 19794 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tgtctcaggagcagtgtttt

SEQ ID NO: 19795 - DNA, 20 bp, Artificial Sequence
  Description of Artificial Sequence: Synthetic oligonucleotide
  Target: ATXN1; (+) strand; PAM type: NNGRRT; PAM sequence: TCGAGT
tcaaaggacattgtagcatt

SEQ ID NO: 19796 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gtctggcttgaactcattat

SEQ ID NO: 19797 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ctgtgaggccagccttgact

SEQ ID NO: 19798 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtcaatgtttctgtagtgtc

SEQ ID NO: 19799 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ggttctgtgtgttccttcac

SEQ ID NO: 19800 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gtgttccttcacctgaattg

SEQ ID NO: 19801 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tgaattgctgggtctgacgt

SEQ ID NO: 19802 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ggatggcctttgttcccttg

SEQ ID NO: 19803 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ttgttcccttgctgggtgag

SEQ ID NO: 19804 - DNA, 20 bp, Artificial Sequence
  Description of Artificial Sequence: Synthetic oligonucleotide
  Target: ATXN1; (+) strand; PAM type: NNGRRT; PAM sequence: ACGGAT
gtagctcttgatctgactgg

SEQ ID NO: 19805 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ggagattccagagaagtcac

SEQ ID NO: 19806 - DNA, 20 bp, Artificial Sequence
  Description of Artificial Sequence: Synthetic oligonucleotide
  Target: ATXN1; (+) strand; PAM type: NNGRRT; PAM sequence: CGGAGT
tcctgtcatcacccccgctc

SEQ ID NO: 19807 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ctactgccatttctatttaa

SEQ ID NO: 19808 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ccatttctatttaaatggat

SEQ ID NO: 19809 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agtgttcagatcattctttg

SEQ ID NO: 19810 - DNA, 20 bp, Artificial Sequence
  Description of Artificial Sequence: Synthetic oligonucleotide
  Target: ATXN1; (+) strand; PAM type: NNGRRT; PAM sequence: TGGAGT
actcatgtcgcaaaccttta

SEQ ID NO: 19811 - DNA, 20 bp, Artificial Sequence
  Description of Artificial Sequence: Synthetic oligonucleotide
  Target: ATXN1; (+) strand; PAM type: NNGRRT; PAM sequence: AGGAAT
acatattagtgatgagcagt

SEQ ID NO: 19812 - DNA, 20 bp, Artificial Sequence
  Description of Artificial Sequence: Synthetic oligonucleotide
  Target: ATXN1; (+) strand; PAM type: NNGRRT; PAM sequence: CGGAAT
tgtatgctgttcctttataa

SEQ ID NO: 19813 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gtaataactgctgaggactt

SEQ ID NO: 19814 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cattgattcaaggttccact

SEQ ID NO: 19815 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaaagttgatgctctttgac

SEQ ID NO: 19816 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gcaaagttttccttcaagca

SEQ ID NO: 19817 - DNA, 20 bp, Artificial Sequence
  Description of Artificial Sequence: Synthetic oligonucleotide
  Target: ATXN1; (+) strand; PAM type: NNGRRT; PAM sequence: ATGAGT
agttttccttcaagcataga

SEQ ID NO: 19818 - DNA, 20 bp, Artificial Sequence
  Description of Artificial Sequence: Synthetic oligonucleotide
  Target: ATXN1; (+) strand; PAM type: NNGRRT; PAM sequence: TGGGAT
agcatagaatgagttccctc

SEQ ID NO: 19819 - DNA, 20 bp, Artificial Sequence
  Description of Artificial Sequence: Synthetic oligonucleotide
  Target: ATXN1; (+) strand; PAM type: NNGRRT; PAM sequence: ACGGAT
ccccctctcagcaatctatt

SEQ ID NO: 19820 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tctattacggatttgtttgc

SEQ ID NO: 19821 - DNA, 20 bp, Artificial Sequence
  Description of Artificial Sequence: Synthetic oligonucleotide
  Target: ATXN1; (+) strand; PAM type: NNGRRT; PAM sequence: TGGAGT
atttgtttgctggaatgact

SEQ ID NO: 19822 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gaatgacttggagtggcagg

SEQ ID NO: 19823 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ttggagtggcaggtggggtc

SEQ ID NO: 19824 - DNA, 20 bp, Artificial Sequence
  Description of Artificial Sequence: Synthetic oligonucleotide
  Target: ATXN1; (+) strand; PAM type: NNGRRT; PAM sequence: GTGAGT
agtggcaggtggggtcagga

SEQ ID NO: 19825 - DNA, 20 bp, Artificial Sequence
  Description of Artificial Sequence: Synthetic oligonucleotide
  Target: ATXN1; (+) strand; PAM type: NNGRRT; PAM sequence: AAGGGT
atttcgtttcatccccagta

SEQ ID NO: 19826 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cccagtaaagggtaagatga

SEQ ID NO: 19827 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tcagtctgctgagatggggc

SEQ ID NO: 19828 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aaaatcccaacctaaaattg

SEQ ID NO: 19829 - DNA, 20 bp, Artificial Sequence
  Description of Artificial Sequence: Synthetic oligonucleotide
  Target: ATXN1; (+) strand; PAM type: NNGRRT; PAM sequence: GGGAAT
cctaaaattgctgagtcagt

SEQ ID NO: 19830 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gagtcagtgggaatttctca

SEQ ID NO: 19831 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agttcattaagttcaagagc

SEQ ID NO: 19832 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gagtcgcttaaaggtagacc

SEQ ID NO: 19833 - DNA, 20 bp, Artificial Sequence
  Description of Artificial Sequence: Synthetic oligonucleotide
  Target: ATXN1; (+) strand; PAM type: NNGRRT; PAM sequence: TGGAGT
acttaggcagccagtaaagc

SEQ ID NO: 19834 - DNA, 20 bp, Artificial Sequence
  Description of Artificial Sequence: Synthetic oligonucleotide
  Target: ATXN1; (+) strand; PAM type: NNGRRT; PAM sequence: CTGAAT
acagaaaataattccccaaa

SEQ ID NO: 19835 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aattccccaaactgaattgc

SEQ ID NO: 19836 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ggctcgttctgtcgccaggc

SEQ ID NO: 19837 - DNA, 20 bp, Artificial Sequence
  Description of Artificial Sequence: Synthetic oligonucleotide
  Target: ATXN1; (+) strand; PAM type: NNGRRT; PAM sequence: CCGAGT
cattctcctgcctcagcctc

SEQ ID NO: 19838 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ttttgtatttttagtagaga

SEQ ID NO: 19839 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tagggtttcactgtgttagc

SEQ ID NO: 19840 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaatgtgc

SEQ ID NO: 19841 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tctagatattttgaggtggt

SEQ ID NO: 19842 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gtatggttcccctactgctc

SEQ ID NO: 19843 - DNA, 20 bp, Artificial Sequence
  Description of Artificial Sequence: Synthetic oligonucleotide
  Target: ATXN1; (+) strand; PAM type: NNGRRT; PAM sequence: CTGGAT
agaaagccatagaaataagc

SEQ ID NO: 19844 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gcctggatgtgatgctattc

SEQ ID NO: 19845 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cccattttattaaactgttc

SEQ ID NO: 19846 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tgccaggcacatcatggtgg

SEQ ID NO: 19847 - DNA, 20 bp, Artificial Sequence
  Description of Artificial Sequence: Synthetic oligonucleotide
  Target: ATXN1; (+) strand; PAM type: NNGRRT; PAM sequence: ATGAGT
cacaaggggctaacagggaa

SEQ ID NO: 19848 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ggcagttgctcctgtcttcc

SEQ ID NO: 19849 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ttttattacactttaagttc

SEQ ID NO: 19850 - DNA, 20 bp, Artificial Sequence
  Description of Artificial Sequence: Synthetic oligonucleotide
  Target: ATXN1; (+) strand; PAM type: NNGRRT; PAM sequence: AGGAGT
acatgtgccatagcagagca

SEQ ID NO: 19851 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cagagcaaggagttccaaaa

SEQ ID NO: 19852 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgttgcccaggc

SEQ ID NO: 19853 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gattcttctgcctcagcctc

SEQ ID NO: 19854 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtagaga

SEQ ID NO: 19855 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acattggcctcccaaagtgc

SEQ ID NO: 19856 - DNA, 20 bp, Artificial Sequence
  Description of Artificial Sequence: Synthetic oligonucleotide
  Target: ATXN1; (+) strand; PAM type: NNGRRT; PAM sequence: CCGAAT
cattgagccactgcgcctgg

SEQ ID NO: 19857 - DNA, 20 bp, Artificial Sequence
  Description of Artificial Sequence: Synthetic oligonucleotide
  Target: ATXN1; (+) strand; PAM type: NNGRRT; PAM sequence: AAGGGT
taaagcatagactacagtca

SEQ ID NO: 19858 - DNA, 20 bp, Artificial Sequence
  Description of Artificial Sequence: Synthetic oligonucleotide
  Target: ATXN1; (+) strand; PAM type: NNGRRT; PAM sequence: GGGAAT
cagtgtttagggaggacaat

SEQ ID NO: 19859 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gctgctcttccacatttata

SEQ ID NO: 19860 - DNA, 20 bp, Artificial Sequence
  Description of Artificial Sequence: Synthetic oligonucleotide
  Target: ATXN1; (+) strand; PAM type: NNGRRT; PAM sequence: ATGGGT
cacttacatgcctgcctgta

SEQ ID NO: 19861 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcctgtaatgggtctatt

SEQ ID NO: 19862 - DNA, 20 bp, Artificial Sequence
  Description of Artificial Sequence: Synthetic oligonucleotide
  Target: ATXN1; (+) strand; PAM type: NNGRRT; PAM sequence: TTGGAT
caatctttaaagaaacaatc

SEQ ID NO: 19863 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ggaaatgacattatattacc

SEQ ID NO: 19864 - DNA, 20 bp, Artificial Sequence
  Description of Artificial Sequence: Synthetic oligonucleotide
  Target: ATXN1; (+) strand; PAM type: NNGRRT; PAM sequence: AGGAAT
cctttgcaacaatcagaagc

SEQ ID NO: 19865 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgcaacaatcagaagcagga

SEQ ID NO: 19866 - DNA, 20 bp, Artificial Sequence
  Description of Artificial Sequence: Synthetic oligonucleotide
  Target: ATXN1; (+) strand; PAM type: NNGRRT; PAM sequence: TAGAAT
atcagaagcaggaatgaatt

SEQ ID NO: 19867 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gaatataacaaaagggcctc

SEQ ID NO: 19868 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttggattttgttagttgatc

SEQ ID NO: 19869 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccgaggcag

SEQ ID NO: 19870 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgggaggctgagacag

SEQ ID NO: 19871 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctacaccactacactccagc

SEQ ID NO: 19872 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctacactccagcctgggtga

SEQ ID NO: 19873 - DNA, 20 bp, Artificial Sequence
  Description of Artificial Sequence: Synthetic oligonucleotide
  Target: ATXN1; (+) strand; PAM type: NNGRRT; PAM sequence: GGGGGT
tgttcacaaaaatatccaat

SEQ ID NO: 19874 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atccaatgggggttctgacc

SEQ ID NO: 19875 - DNA, 20 bp, Artificial Sequence
  Description of Artificial Sequence: Synthetic oligonucleotide
  Target: ATXN1; (+) strand; PAM type: NNGRRT; PAM sequence: CCGAGT
tattagcagcctctgtgaac

SEQ ID NO: 19876 - DNA, 20 bp, Artificial Sequence
  Description of Artificial Sequence: Synthetic oligonucleotide
  Target: ATXN1; (+) strand; PAM type: NNGRRT; PAM sequence: GGGGGT
cattgacatattgatagtgt

SEQ ID NO: 19877 - DNA, 20 bp, Artificial Sequence
  Description of Artificial Sequence: Synthetic oligonucleotide
  Target: ATXN1; (+) strand; PAM type: NNGRRT; PAM sequence: GTGGAT
gctttttgagctcaaaacct

SEQ ID NO: 19878 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtagacacattgctgcccaa

SEQ ID NO: 19879 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ctggcaagtgtctttggaaa

SEQ ID NO: 19880 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tcttcctcctttctgctttc

SEQ ID NO: 19881 - DNA, 20 bp, Artificial Sequence
  Description of Artificial Sequence: Synthetic oligonucleotide
  Target: ATXN1; (+) strand; PAM type: NNGRRT; PAM sequence: GCGGGT
tatgtgagacataggctgag

SEQ ID NO: 19882 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggtgcatcacttgaggtc

SEQ ID NO: 19883 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tccagcctgggagacagagc

SEQ ID NO: 19884 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agaaatatactacagcatgg

SEQ ID NO: 19885 - DNA, 20 bp, Artificial Sequence
  Description of Artificial Sequence: Synthetic oligonucleotide
  Target: ATXN1; (+) strand; PAM type: NNGRRT; PAM sequence: CAGAGT
taaatgtctcaatcgggaag

SEQ ID NO: 19886 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgcctatcagtatctgctaa

SEQ ID NO: 19887 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gttttatatttcacatgtct

SEQ ID NO: 19888 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tcccaagtcacacatattca

SEQ ID NO: 19889 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aaataataaaaaatgtgatg

SEQ ID NO: 19890 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ctaaatggagattttcaaat

SEQ ID NO: 19891 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttgggtgaaaagtcagtatc

SEQ ID NO: 19892 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tgtagctgtaaaatatatcc

SEQ ID NO: 19893 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tatatccctggatgctttta

SEQ ID NO: 19894 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tgaaacactctctgaaacta

SEQ ID NO: 19895 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caaatggaaaatgatcctgg

SEQ ID NO: 19896 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tccttcgtacctccacccac

SEQ ID NO: 19897 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tcgtacctccacccacatgg

SEQ ID NO: 19898 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tacgctacagaaatgagcag

SEQ ID NO: 19899 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tgcggtaaatgcccatggac

SEQ ID NO: 19900 - DNA, 20 bp, Artificial Sequence
  Description of Artificial Sequence: Synthetic oligonucleotide
  Target: ATXN1; (+) strand; PAM type: NNGRRT; PAM sequence: AAGGGT
caggcatttaaagatgtgca

SEQ ID NO: 19901 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gggactatttgccttgaaaa

SEQ ID NO: 19902 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gagttttctccagctctgca

SEQ ID NO: 19903 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ccttctaactcttcatgctg

SEQ ID NO: 19904 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tgatctgatctgctcctccc

SEQ ID NO: 19905 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tcccaggaatcctgcatgag

SEQ ID NO: 19906 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tcctgcatgaggtggatatc

SEQ ID NO: 19907 - DNA, 20 bp, Artificial Sequence
  Description of Artificial Sequence: Synthetic oligonucleotide
  Target: ATXN1; (+) strand; PAM type: NNGRRT; PAM sequence: TGGAGT
cagggctgctgctttgaccc

SEQ ID NO: 19908 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gctttgaccctggagttgag

SEQ ID NO: 19909 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aaaatgcaactgtttttcat

SEQ ID NO: 19910 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tctatgcatgtttacaaagt

SEQ ID NO: 19911 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tttacaaagttagaataatt

SEQ ID NO: 19912 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ataattctgaatatataatt

SEQ ID NO: 19913 - DNA, 20 bp, Artificial Sequence
  Description of Artificial Sequence: Synthetic oligonucleotide
  Target: ATXN1; (+) strand; PAM type: NNGRRT; PAM sequence: TAGAAT
acttaacattgtattgtaac

SEQ ID NO: 19914 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tttttaaagctagttaaagg

SEQ ID NO: 19915 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aaagcacttggcaaatggta

SEQ ID NO: 19916 - DNA, 20 bp, Artificial Sequence
  Description of Artificial Sequence: Synthetic oligonucleotide
  Target: ATXN1; (+) strand; PAM type: NNGRRT; PAM sequence: TTGAGT
aatcagtgagcaaatattaa

SEQ ID NO: 19917 - DNA, 20 bp, Artificial Sequence
  Description of Artificial Sequence: Synthetic oligonucleotide
  Target: ATXN1; (+) strand; PAM type: NNGRRT; PAM sequence: TGGGAT
attattctaggagccatgcc

SEQ ID NO: 19918 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ggatgtcgtggtggctaaga

SEQ ID NO: 19919 - DNA, 20 bp, Artificial Sequence
  Description of Artificial Sequence: Synthetic oligonucleotide
  Target: ATXN1; (+) strand; PAM type: NNGRRT; PAM sequence: TAGAGT
agtccctactattgggagca

SEQ ID NO: 19920 - DNA, 20 bp, Artificial Sequence
  Description of Artificial Sequence: Synthetic oligonucleotide
  Target: ATXN1; (+) strand; PAM type: NNGRRT; PAM sequence: GAGAAT
catagagtgtcagaaattaa

SEQ ID NO: 19921 - DNA, 20 bp, Artificial Sequence
  Description of Artificial Sequence: Synthetic oligonucleotide
  Target: ATXN1; (+) strand; PAM type: NNGRRT; PAM sequence: TAGAAT
caatttgctttcacaccaac

SEQ ID NO: 19922 - DNA, 20 bp, Artificial Sequence
  Description of Artificial Sequence: Synthetic oligonucleotide
  Target: ATXN1; (+) strand; PAM type: NNGRRT; PAM sequence: AAGAAT
caccaactagaatggtgtga

SEQ ID NO: 19923 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aagaatggtttgcaaagcaa

SEQ ID NO: 19924 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aatgatgcataccatcgtct

SEQ ID NO: 19925 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aaatattttgttaattaaaa

SEQ ID NO: 19926 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttttttttgcttttcattaa

SEQ ID NO: 19927 - DNA, 20 bp, Artificial Sequence
  Description of Artificial Sequence: Synthetic oligonucleotide
  Target: ATXN1; (+) strand; PAM type: NNGRRT; PAM sequence: GTGAAT
actggactttctccaagcat

SEQ ID NO: 19928 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gactttctccaagcatgtga

SEQ ID NO: 19929 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ctccaagcatgtgaatgagt

SEQ ID NO: 19930 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tattgtaccatgcaaaaact

SEQ ID NO: 19931 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aaaagaaaccaatatttgac

SEQ ID NO: 19932 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttcttttttttgagccgaga

SEQ ID NO: 19933 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gggtcttgctctgttgcatc

SEQ ID NO: 19934 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gatcctcccatctcagcttc

SEQ ID NO: 19935 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tttatttttttcagtagaga

SEQ ID NO: 19936 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gccttagcctcccaaagtgc

SEQ ID NO: 19937 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ttctttgacttctttctcta

SEQ ID NO: 19938 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tgattaaacccagggcaagc

SEQ ID NO: 19939 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ttttcttttataaaacagga

SEQ ID NO: 19940 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gacagaaacaagaggaagga

SEQ ID NO: 19941 - DNA, 20 bp, Artificial Sequence
  Description of Artificial Sequence: Synthetic oligonucleotide
  Target: ATXN1; (+) strand; PAM type: NNGRRT; PAM sequence: TAGAAT
acagaaaagaagtacacagg

SEQ ID NO: 19942 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gaagtacacaggtagaattg

SEQ ID NO: 19943 - DNA, 20 bp, Artificial Sequence
  Description of Artificial Sequence: Synthetic oligonucleotide
  Target: ATXN1; (+) strand; PAM type: NNGRRT; PAM sequence: CCGAGT
agctgtggagaaactgcaaa

SEQ ID NO: 19944 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tcagccccaaccatgcccat

SEQ ID NO: 19945 - DNA, 20 bp, Artificial Sequence
  Description of Artificial Sequence: Synthetic oligonucleotide
  Target: ATXN1; (+) strand; PAM type: NNGRRT; PAM sequence: ATGGAT
accatgcccatttggataaa

SEQ ID NO: 19946 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gtctgtaatccaagctcttt

SEQ ID NO: 19947 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tctttgggagtctgaggcag

SEQ ID NO: 19948 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cagaaggatcacttgagccc

SEQ ID NO: 19949 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tactagggaggctgaggcag

SEQ ID NO: 19950 - DNA, 20 bp, Artificial Sequence
  Description of Artificial Sequence: Synthetic oligonucleotide
  Target: ATXN1; (+) strand; PAM type: NNGRRT; PAM sequence: TAGAGT
acaaataaatgaacctgtgg

SEQ ID NO: 19951 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aatgaacctgtggtagagta

SEQ ID NO: 19952 - DNA, 20 bp, Artificial Sequence
  Description of Artificial Sequence: Synthetic oligonucleotide
  Target: ATXN1; (+) strand; PAM type: NNGRRT; PAM sequence: GGGGAT
actccatggaggaggtttct

SEQ ID NO: 19953 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aatgatccataatttcttgt

SEQ ID NO: 19954 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtccccacccaagtgtcatc

SEQ ID NO: 19955 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agggacctgctgggagacaa

SEQ ID NO: 19956 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cccatactgttctcgtggta

SEQ ID NO: 19957 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ctccccagccacgtggaact

SEQ ID NO: 19958 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tctttataaattacctaggc

SEQ ID NO: 19959 - DNA, 20 bp, Artificial Sequence
  Description of Artificial Sequence: Synthetic oligonucleotide
  Target: ATXN1; (+) strand; PAM type: NNGRRT; PAM sequence: TCGAAT
cttagcatctgctatatacc

SEQ ID NO: 19960 - DNA, 20 bp, Artificial Sequence
  Description of Artificial Sequence: Synthetic oligonucleotide
  Target: ATXN1; (+) strand; PAM type: NNGRRT; PAM sequence: TAGGAT
cgaattataccagaagcttt

SEQ ID NO: 19961 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tatgctcgattagcaagcta

SEQ ID NO: 19962 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aagttccacagagccctttc

SEQ ID NO: 19963 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tataaatggtgatgtatcat

SEQ ID NO: 19964 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tgatgtatcatctgggttag

SEQ ID NO: 19965 - DNA, 20 bp, Artificial Sequence
  Description of Artificial Sequence: Synthetic oligonucleotide
  Target: ATXN1; (+) strand; PAM type: NNGRRT; PAM sequence: TTGGAT
acctgtgagcatcgtgaggt

SEQ ID NO: 19966 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tatagagcgaagctggggcc

SEQ ID NO: 19967 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ccccagcacataaatattag

SEQ ID NO: 19968 - DNA, 20 bp, Artificial Sequence
  Description of Artificial Sequence: Synthetic oligonucleotide
  Target: ATXN1; (+) strand; PAM type: NNGRRT; PAM sequence: AGGAAT
taggggaatgctatagaagg

SEQ ID NO: 19969 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agaaatacatctgagcaaca

SEQ ID NO: 19970 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tgagcaacacagaattgctg

SEQ ID NO: 19971 - DNA, 20 bp, Artificial Sequence
  Description of Artificial Sequence: Synthetic oligonucleotide
  Target: ATXN1; (+) strand; PAM type: NNGRRT; PAM sequence: GAGGGT
cagttttccaaggacaagag

SEQ ID NO: 19972 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tatggcattaacccgagccc

SEQ ID NO: 19973 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aattctgtaggcatgcaaat

SEQ ID NO: 19974 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gcagctttgcagaagtgctg

SEQ ID NO: 19975 - DNA, 20 bp, Artificial Sequence
  Description of Artificial Sequence: Synthetic oligonucleotide
  Target: ATXN1; (+) strand; PAM type: NNGRRT; PAM sequence: AGGAGT
aagaagaacaccaaggagaa

SEQ ID NO: 19976 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tggcatgatcaggaaggcac

SEQ ID NO: 19977 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggaaggcacctggatttgaa

SEQ ID NO: 19978 - DNA, 20 bp, Artificial Sequence
  Description of Artificial Sequence: Synthetic oligonucleotide
  Target: ATXN1; (+) strand; PAM type: NNGRRT; PAM sequence: TAGAAT
agaactacagctctgttact

SEQ ID NO: 19979 - DNA, 20 bp, Artificial Sequence
  Description of Artificial Sequence: Synthetic oligonucleotide
  Target: ATXN1; (+) strand; PAM type: NNGRRT; PAM sequence: GCGAAT
taacacccatcctgagccca

SEQ ID NO: 19980 - DNA, 20 bp, Artificial Sequence
  Description of Artificial Sequence: Synthetic oligonucleotide
  Target: ATXN1; (+) strand; PAM type: NNGRRT; PAM sequence: CTGGGT
attttggaacatgagaaagg

SEQ ID NO: 19981 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tacccacttgtcatttgtaa

SEQ ID NO: 19982 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ttgtcatttgtaagtgagtg

SEQ ID NO: 19983 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ccttcctatgatactaattt

SEQ ID NO: 19984 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gtgcccacctagattgctct

SEQ ID NO: 19985 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tttggaaaatatactccatt

SEQ ID NO: 19986 - DNA, 20 bp, Artificial Sequence
  Description of Artificial Sequence: Synthetic oligonucleotide
  Target: ATXN1; (+) strand; PAM type: NNGRRT; PAM sequence: CGGGAT
ccccatggcacagctgcctg

SEQ ID NO: 19987 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aaggagaagcaatgctcact

SEQ ID NO: 19988 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aatgctcacttggggtgtgt

SEQ ID NO: 19989 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttgactagcctgtctaccca

SEQ ID NO: 19990 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agaatttcatttaatctagg

SEQ ID NO: 19991 - DNA, 20 bp, Artificial Sequence
  Description of Artificial Sequence: Synthetic oligonucleotide
  Target: ATXN1; (+) strand; PAM type: NNGRRT; PAM sequence: GTGGAT
cctgtggaggtgggaaaatg

SEQ ID NO: 19992 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tggagagaggccatatacac

SEQ ID NO: 19993 - DNA, 20 bp, Artificial Sequence
  Description of Artificial Sequence: Synthetic oligonucleotide
  Target: ATXN1; (+) strand; PAM type: NNGRRT; PAM sequence: GAGAAT
acaatttccctttatttcag

SEQ ID NO: 19994 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ccctttatttcaggagaatc

SEQ ID NO: 19995 - DNA, 20 bp, Artificial Sequence
  Description of Artificial Sequence: Synthetic oligonucleotide
  Target: ATXN1; (+) strand; PAM type: NNGRRT; PAM sequence: TTGAAT
acattatttttttctgacac

SEQ ID NO: 19996 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ggactcaaaaaaacagtctt

SEQ ID NO: 19997 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gcagacattcttgaaaggta

SEQ ID NO: 19998 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ctttcagtatccctcatata

SEQ ID NO: 19999 - DNA, 20 bp, Artificial Sequence
  Description of Artificial Sequence: Synthetic oligonucleotide
  Target: ATXN1; (+) strand; PAM type: NNGRRT; PAM sequence: TGGAGT
aaagtttgaaaccattcaac

SEQ ID NO: 20000 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tttgaaaccattcaactgga

SEQ ID NO: 20001 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tgagcctgcttttctgtgtg

SEQ ID NO: 20002 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttttctgtgtgaagaatgta

SEQ ID NO: 20003 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tcccattgctgtgcaccttc

SEQ ID NO: 20004 - DNA, 20 bp, Artificial Sequence
  Description of Artificial Sequence: Synthetic oligonucleotide
  Target: ATXN1; (+) strand; PAM type: NNGRRT; PAM sequence: GAGGGT
atgggtcatacaggttatat

SEQ ID NO: 20005 - DNA, 20 bp, Artificial Sequence
  Description of Artificial Sequence: Synthetic oligonucleotide
  Target: ATXN1; (+) strand; PAM type: NNGRRT; PAM sequence: GAGGGT
acaggttatatgagggtccg

SEQ ID NO: 20006 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aagaaaccatcacagctcac

SEQ ID NO: 20007 - DNA, 20 bp, Artificial Sequence
  Description of Artificial Sequence: Synthetic oligonucleotide
  Target: ATXN1; (+) strand; PAM type: NNGRRT; PAM sequence: GGGGGT
actgggattagtgctccact

SEQ ID NO: 20008 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tagtgctccactgggggtag

SEQ ID NO: 20009 - DNA, 20 bp, Artificial Sequence
  Description of Artificial Sequence: Synthetic oligonucleotide
  Target: ATXN1; (+) strand; PAM type: NNGRRT; PAM sequence: GCGGGT
gtacgcctgtgtgcacagga

SEQ ID NO: 20010 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ggtgtgaggtggctgctgac

SEQ ID NO: 20011 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cagagaagacaagatgtaag

SEQ ID NO: 20012 - DNA, 20 bp, Artificial Sequence
  Description of Artificial Sequence: Synthetic oligonucleotide
  Target: ATXN1; (+) strand; PAM type: NNGRRT; PAM sequence: GAGAAT
taagcacacgcagtgtttgg

SEQ ID NO: 20013 - DNA, 20 bp, Artificial Sequence
  Description of Artificial Sequence: Synthetic oligonucleotide
  Target: ATXN1; (+) strand; PAM type: NNGRRT; PAM sequence: CAGGGT
taaggctccaccaggtcttt

SEQ ID NO: 20014 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aagggaagttcccaggagca

SEQ ID NO: 20015 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tttatttatttatttagaga

SEQ ID NO: 20016 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcaccgaggc

SEQ ID NO: 20017 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tatcctcccacctcagcctc

SEQ ID NO: 20018 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cccaggctggtctcaaactc

SEQ ID NO: 20019 - DNA, 20 bp, Artificial Sequence
  Description of Artificial Sequence: Synthetic oligonucleotide
  Target: ATXN1; (+) strand; PAM type: NNGRRT; PAM sequence: GGGAGT
cctcagcttcccaaaatgct

SEQ ID NO: 20020 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ccgattcagcaagcccacta

SEQ ID NO: 20021 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ccaacccaaatgcccatcaa

SEQ ID NO: 20022 - DNA, 20 bp, Artificial Sequence
  Description of Artificial Sequence: Synthetic oligonucleotide
  Target: ATXN1; (+) strand; PAM type: NNGRRT; PAM sequence: GTGGAT
cccaaatgcccatcaattga

SEQ ID NO: 20023 - DNA, 20 bp, Artificial Sequence
  Description of Artificial Sequence: Synthetic oligonucleotide
  Target: ATXN1; (+) strand; PAM type: NNGRRT; PAM sequence: TGGAAT
actgtggtacatatatatga

SEQ ID NO: 20024 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aatactactcagccataaaa

SEQ ID NO: 20025 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ctactcagccataaaaagga

SEQ ID NO: 20026 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ttaacagcatttgcagtgac

SEQ ID NO: 20027 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tattctaagtgaagtaactc

SEQ ID NO: 20028 - DNA, 20 bp, Artificial Sequence
  Description of Artificial Sequence: Synthetic oligonucleotide
  Target: ATXN1; (+) strand; PAM type: NNGRRT; PAM sequence: GAGGAT
atatgtgagagctaagctat

SEQ ID NO: 20029 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctatgaggatgcaaaggcat

SEQ ID NO: 20030 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gactttgggcacttaggggg

SEQ ID NO: 20031 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gggcacttagggggaagagt

SEQ ID NO: 20032 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ggaagagtgggagtggggag

SEQ ID NO: 20033 - DNA, 20 bp, Artificial Sequence
  Description of Artificial Sequence: Synthetic oligonucleotide
  Target: ATXN1; (+) strand; PAM type: NNGRRT; PAM sequence: ATGGGT
cagtgtatactgctcaggtg

SEQ ID NO: 20034 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttattattatgccacttatt

SEQ ID NO: 20035 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cttgtgatgcaacgcaactg

SEQ ID NO: 20036 - DNA, 20 bp, Artificial Sequence
  Description of Artificial Sequence: Synthetic oligonucleotide
  Target: ATXN1; (+) strand; PAM type: NNGRRT; PAM sequence: ATGAGT
taggtattagggaaacagag

SEQ ID NO: 20037 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aagtgtacaggaagctctag

SEQ ID NO: 20038 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tttttgaacatatcctcaag

SEQ ID NO: 20039 - DNA, 20 bp, Artificial Sequence
  Description of Artificial Sequence: Synthetic oligonucleotide
  Target: ATXN1; (+) strand; PAM type: NNGRRT; PAM sequence: AAGGAT
atcctcaagatgagttttga

SEQ ID NO: 20040 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gaacaaaataggaaacttag

SEQ ID NO: 20041 - DNA, 20 bp, Artificial Sequence
  Description of Artificial Sequence: Synthetic oligonucleotide
  Target: ATXN1; (+) strand; PAM type: NNGRRT; PAM sequence: TAGAAT
cacatccacccagcaggcta

SEQ ID NO: 20042 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atgtttctctcccaagggca

SEQ ID NO: 20043 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gcaatgaattggtttagcca

SEQ ID NO: 20044 - DNA, 20 bp, Artificial Sequence
  Description of Artificial Sequence: Synthetic oligonucleotide
  Target: ATXN1; (+) strand; PAM type: NNGRRT; PAM sequence: GCGGGT
aggaggtcctcaacatgcca

SEQ ID NO: 20045 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ggtacttccctgattttggt

SEQ ID NO: 20046 - DNA, 20 bp, Artificial Sequence
  Description of Artificial Sequence: Synthetic oligonucleotide
  Target: ATXN1; (+) strand; PAM type: NNGRRT; PAM sequence: CTGAAT
acagaagccaggagaagggg

SEQ ID NO: 20047 - DNA, 20 bp, Artificial Sequence
  Description of Artificial Sequence: Synthetic oligonucleotide
  Target: ATXN1; (+) strand; PAM type: NNGRRT; PAM sequence: GTGAGT
catctgttcacaaactttca

SEQ ID NO: 20048 - DNA, 20 bp, Artificial Sequence
  Description of Artificial Sequence: Synthetic oligonucleotide
  Target: ATXN1; (+) strand; PAM type: NNGRRT; PAM sequence: GTGAGT
atttattatctaatattctt

SEQ ID NO: 20049 - DNA, 20 bp, Artificial Sequence
  Description of Artificial Sequence: Synthetic oligonucleotide
  Target: ATXN1; (+) strand; PAM type: NNGRRT; PAM sequence: CTGGAT
attcttgtgagttcctgtgt

SEQ ID NO: 20050 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gtcaaaactaacgtggcatt

SEQ ID NO: 20051 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aaactaacgtggcattcagg

SEQ ID NO: 20052 - DNA, 20 bp, Artificial Sequence
  Description of Artificial Sequence: Synthetic oligonucleotide
  Target: ATXN1; (+) strand; PAM type: NNGRRT; PAM sequence: GTGAGT
agggtgggtgactgatccat

SEQ ID NO: 20053 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atccatgtgagtgctcttaa

SEQ ID NO: 20054 - DNA, 20 bp, Artificial Sequence
  Description of Artificial Sequence: Synthetic oligonucleotide
  Target: ATXN1; (+) strand; PAM type: NNGRRT; PAM sequence: GGGAGT
aggccataaatagctcttag

SEQ ID NO: 20055 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ggccccgttacctcaaatca

SEQ ID NO: 20056 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctggcaggcattgttatggg

SEQ ID NO: 20057 - DNA, 20 bp, Artificial Sequence
  Description of Artificial Sequence: Synthetic oligonucleotide
  Target: ATXN1; (+) strand; PAM type: NNGRRT; PAM sequence: CTGAAT
catcctgacccctaatacct

SEQ ID NO: 20058 - DNA, 20 bp, Artificial Sequence
  Description of Artificial Sequence: Synthetic oligonucleotide
  Target: ATXN1; (+) strand; PAM type: NNGRRT; PAM sequence: TAGGGT
aatgtgaacttacttggaaa

SEQ ID NO: 20059 - DNA, 20 bp, Artificial Sequence
  Description of Artificial Sequence: Synthetic oligonucleotide
  Target: ATXN1; (+) strand; PAM type: NNGRRT; PAM sequence: AGGGGT
atgaggtcatcctggaggag

SEQ ID NO: 20060 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggtcgaggcag

SEQ ID NO: 20061 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggcaggcggatcatgaggtc

SEQ ID NO: 20062 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctataattccagctactcgg

SEQ ID NO: 20063 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgggagaatgagggag

SEQ ID NO: 20064 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcgcaccactgcaccccagc

SEQ ID NO: 20065 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tgtggactcaggcacacagg

SEQ ID NO: 20066 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gcagagtgctctgtgaggac

SEQ ID NO: 20067 - DNA, 20 bp, Artificial Sequence
  Description of Artificial Sequence: Synthetic oligonucleotide
  Target: ATXN1; (+) strand; PAM type: NNGRRT; PAM sequence: GGGAGT
taaggagccaccagaagcta

SEQ ID NO: 20068 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ataatgccgtttgtgtgtga

SEQ ID NO: 20069 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgacttcatcatccagtggc

SEQ ID NO: 20070 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gtccccagtggtcagtcatg

SEQ ID NO: 20071 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tacatttatagatttagaca

SEQ ID NO: 20072 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gatttagacatggagttata

SEQ ID NO: 20073 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actttgggaggccaaggcag

SEQ ID NO: 20074 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggaggatcccttgaggcc

SEQ ID NO: 20075 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ttaaaaaaatagccaggcag

SEQ ID NO: 20076 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aggcggagcttgcagtgagc

SEQ ID NO: 20077 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tcacttgggcccagaagttt

SEQ ID NO: 20078 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcgtgccagtgctctccagc

SEQ ID NO: 20079 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgctctccagcctgggtgac

SEQ ID NO: 20080 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctctccctaaagaaaagaaa

SEQ ID NO: 20081 - DNA, 20 bp, Artificial Sequence
  Description of Artificial Sequence: Synthetic oligonucleotide
  Target: ATXN1; (+) strand; PAM type: NNGRRT; PAM sequence: AGGGGT
attaataatgcaaagaagtt

SEQ ID NO: 20082 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ataatgcaaagaagttaggg

SEQ ID NO: 20083 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gcaaagaagttaggggtggg

SEQ ID NO: 20084 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ggtgggtggggtgagagaac

SEQ ID NO: 20085 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gtctgttactgtagcctagg

SEQ ID NO: 20086 - DNA, 20 bp, Artificial Sequence
  Description of Artificial Sequence: Synthetic oligonucleotide
  Target: ATXN1; (+) strand; PAM type: NNGRRT; PAM sequence: AAGGGT
actgtagcctaggtagagtg

SEQ ID NO: 20087 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ccaagactcacatctagagc

SEQ ID NO: 20088 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ccaagtgttcctgggaaggc

SEQ ID NO: 20089 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ggaaggcctggatggcagag

SEQ ID NO: 20090 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gcagaggtgaatgggagggg

SEQ ID NO: 20091 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aatgggagggggggagtggg

SEQ ID NO: 20092 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gagtggggagggtggaagtg

SEQ ID NO: 20093 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caccatatcttctcttaagg

SEQ ID NO: 20094 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ttgacctttctgacctcaca

SEQ ID NO: 20095 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctccttagatggtgaggaaa

SEQ ID NO: 20096 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaagaactgggaggactgtt

SEQ ID NO: 20097 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tcacgtaatgggagaggcga

SEQ ID NO: 20098 - DNA, 20 bp, Artificial Sequence
  Description of Artificial Sequence: Synthetic oligonucleotide
  Target: ATXN1; (+) strand; PAM type: NNGRRT; PAM sequence: CTGGAT
atctattattaatgataata

SEQ ID NO: 20099 - DNA, 20 bp, Artificial Sequence
  Description of Artificial Sequence: Synthetic oligonucleotide
  Target: ATXN1; (+) strand; PAM type: NNGRRT; PAM sequence: ACGGGT
cagctagtctggggacaaaa

SEQ ID NO: 20100 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cagcatcttttctgccccaa

SEQ ID NO: 20101 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tttctgccccaaagggatga

SEQ ID NO: 20102 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ggccaatgaagtaaaggtca

SEQ ID NO: 20103 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aacctgtcatagaaaaggtc

SEQ ID NO: 20104 - DNA, 20 bp, Artificial Sequence
  Description of Artificial Sequence: Synthetic oligonucleotide
  Target: ATXN1; (+) strand; PAM type: NNGRRT; PAM sequence: CAGGAT
catgaatgtagtgccagcta

SEQ ID NO: 20105 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tcatgagatttggtcagtaa

SEQ ID NO: 20106 - DNA, 20 bp, Artificial Sequence
  Description of Artificial Sequence: Synthetic oligonucleotide
  Target: ATXN1; (+) strand; PAM type: NNGRRT; PAM sequence: TGGGGT
acagtcatgccaaggttatg

SEQ ID NO: 20107 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ccaaggttatgtggggtatg

SEQ ID NO: 20108 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tgttctctctgtaccctgtc

SEQ ID NO: 20109 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tcatattttgataccacagt

SEQ ID NO: 20110 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ctgttttctctgacttctcc

SEQ ID NO: 20111 - DNA, 20 bp, Artificial Sequence
  Description of Artificial Sequence: Synthetic oligonucleotide
  Target: ATXN1; (+) strand; PAM type: NNGRRT; PAM sequence: TGGAAT
cgtgattaaacaactgaaca

SEQ ID NO: 20112 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gccacagaaggttctctaaa

SEQ ID NO: 20113 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aacaaatggcacagatagca

SEQ ID NO: 20114 - DNA, 20 bp, Artificial Sequence
  Description of Artificial Sequence: Synthetic oligonucleotide
  Target: ATXN1; (+) strand; PAM type: NNGRRT; PAM sequence: ATGAGT
cctaacacttcattcaccaa

SEQ ID NO: 20115 - DNA, 20 bp, Artificial Sequence
  Description of Artificial Sequence: Synthetic oligonucleotide
  Target: ATXN1; (+) strand; PAM type: NNGRRT; PAM sequence: CTGGAT
aagggcctggtgggagatga

SEQ ID NO: 20116 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ccctctctgttctcatgata

SEQ ID NO: 20117 - DNA, 20 bp, Artificial Sequence
  Description of Artificial Sequence: Synthetic oligonucleotide
  Target: ATXN1; (+) strand; PAM type: NNGRRT; PAM sequence: ATGAGT
agacactaaaaatcttacat

SEQ ID NO: 20118 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aaatcttacatatgagtttc

SEQ ID NO: 20119 - DNA, 20 bp, Artificial Sequence
  Description of Artificial Sequence: Synthetic oligonucleotide
  Target: ATXN1; (+) strand; PAM type: NNGRRT; PAM sequence: CAGAGT
agtttcatgggtgggaagca

SEQ ID NO: 20120 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tgagaccaggagggaaaagt

SEQ ID NO: 20121 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gggctccttggagctgatgg

SEQ ID NO: 20122 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ccttggagctgatggcaggg

SEQ ID NO: 20123 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gatggcagggttgagttttg

SEQ ID NO: 20124 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ttgagttttgaagagtacac

SEQ ID NO: 20125 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gacagaggagggagctcatg

SEQ ID NO: 20126 - DNA, 20 bp, Artificial Sequence
  Description of Artificial Sequence: Synthetic oligonucleotide
  Target: ATXN1; (+) strand; PAM type: NNGRRT; PAM sequence: ACGAGT
aggaggggaggaaggaggta

SEQ ID NO: 20127 - DNA, 20 bp, Artificial Sequence
  Description of Artificial Sequence: Synthetic oligonucleotide
  Target: ATXN1; (+) strand; PAM type: NNGRRT; PAM sequence: GAGAAT
agatatctcttgaaggtatg

SEQ ID NO: 20128 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gaaggtatggagaatctcag

SEQ ID NO: 20129 - DNA, 20 bp, Artificial Sequence
  Description of Artificial Sequence: Synthetic oligonucleotide
  Target: ATXN1; (+) strand; PAM type: NNGRRT; PAM sequence: TAGAGT
taaaaatgtcactctggtca

SEQ ID NO: 20130 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ctctggtcatagagtagaag

SEQ ID NO: 20131 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cagactcagcaccaaggctg

SEQ ID NO: 20132 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ttaatttctcgttttacttc

SEQ ID NO: 20133 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aatagcttgcaacttattca

SEQ ID NO: 20134 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctaatcattcctatcttact

SEQ ID NO: 20135 - DNA, 20 bp, Artificial Sequence
  Description of Artificial Sequence: Synthetic oligonucleotide
  Target: ATXN1; (+) strand; PAM type: NNGRRT; PAM sequence: TAGGGT
attcctatcttactctgggt

SEQ ID NO: 20136 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tctaggtagagatagatgct

SEQ ID NO: 20137 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctctaaagcagtctgcatta

SEQ ID NO: 20138 - DNA, 20 bp, Artificial Sequence
  Description of Artificial Sequence: Synthetic oligonucleotide
  Target: ATXN1; (+) strand; PAM type: NNGRRT; PAM sequence: AGGAAT
cagcaaagaagccacaattc

SEQ ID NO: 20139 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tgctgctgctttgtagtctg

SEQ ID NO: 20140 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gcgttaaccataaaaaaatg

SEQ ID NO: 20141 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttgcaaaggcacaagattgt

SEQ ID NO: 20142 - DNA, 20 bp, Artificial Sequence
  Description of Artificial Sequence: Synthetic oligonucleotide
  Target: ATXN1; (+) strand; PAM type: NNGRRT; PAM sequence: GTGGAT
aaaccaatacattaacatat

SEQ ID NO: 20143 - DNA, 20 bp, Artificial Sequence
  Description of Artificial Sequence: Synthetic oligonucleotide
  Target: ATXN1; (+) strand; PAM type: NNGRRT; PAM sequence: TTGAGT
agagcaaatgtgggagctcc

SEQ ID NO: 20144 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gctgcacaaggccaccaggg

SEQ ID NO: 20145 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctggtgaaggaccttgtgta

SEQ ID NO: 20146 - DNA, 20 bp, Artificial Sequence
  Description of Artificial Sequence: Synthetic oligonucleotide
  Target: ATXN1; (+) strand; PAM type: NNGRRT; PAM sequence: CTGAAT
taactccttgggctcatagg

SEQ ID NO: 20147 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tgaatgcctctgaacatgaa

SEQ ID NO: 20148 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttgattatttttaaaggaga

SEQ ID NO: 20149 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gcctcagcctcccaaagtgc

SEQ ID NO: 20150 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aaatacatgcatctggcaca

SEQ ID NO: 20151 - DNA, 20 bp, Artificial Sequence
  Description of Artificial Sequence: Synthetic oligonucleotide
  Target: ATXN1; (+) strand; PAM type: NNGRRT; PAM sequence: CTGAAT
acaagggatcaagcaaatct

SEQ ID NO: 20152 - DNA, 20 bp, Artificial Sequence
  Description of Artificial Sequence: Synthetic oligonucleotide
  Target: ATXN1; (+) strand; PAM type: NNGRRT; PAM sequence: ACGGAT
tcaatgactcaatggtggtc

SEQ ID NO: 20153 - DNA, 20 bp, Artificial Sequence
  Description of Artificial Sequence: Synthetic oligonucleotide
  Target: ATXN1; (+) strand; PAM type: NNGRRT; PAM sequence: CCGGAT
tctcaactaaccatgagaac

SEQ ID NO: 20154 - DNA, 20 bp, Artificial Sequence
  Description of Artificial Sequence: Synthetic oligonucleotide
  Target: ATXN1; (+) strand; PAM type: NNGRRT; PAM sequence: TAGGGT
taaattgccattgctcccta

SEQ ID NO: 20155 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ctatagggtcatcagaaagc

SEQ ID NO: 20156 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgtggaggcaccacatatct

SEQ ID NO: 20157 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gcaccacatatctctgaatg

SEQ ID NO: 20158 - DNA, 20 bp, Artificial Sequence
  Description of Artificial Sequence: Synthetic oligonucleotide
  Target: ATXN1; (+) strand; PAM type: NNGRRT; PAM sequence: TTGGGT
gggaggtggtgccctgctac

SEQ ID NO: 20159 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tcgtgattctcaaacaaggc

SEQ ID NO: 20160 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cctcccagggacatctgaaa

SEQ ID NO: 20161 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgaaaaggagtggggccatt

SEQ ID NO: 20162 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aaacaacttggaaacattgt

SEQ ID NO: 20163 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aacttggaaacattgttggg

SEQ ID NO: 20164 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cattgttgggatgagtaggt

SEQ ID NO: 20165 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tgagtaggtagggatgaacc

SEQ ID NO: 20166 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tagaacagatagcattgtct

SEQ ID NO: 20167 - DNA, 20 bp, Artificial Sequence
  Description of Artificial Sequence: Synthetic oligonucleotide
  Target: ATXN1; (+) strand; PAM type: NNGRRT; PAM sequence: TCGAAT
tcttccttccacataaaata

SEQ ID NO: 20168 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ctgtcaaaaatataatacct

SEQ ID NO: 20169 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaatcttaacaacaacaaca

SEQ ID NO: 20170 - DNA, 20 bp, Artificial Sequence
  Description of Artificial Sequence: Synthetic oligonucleotide
  Target: ATXN1; (+) strand; PAM type: NNGRRT; PAM sequence: GTGGAT
caacaacaacaatgaattta

SEQ ID NO: 20171 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gtcagtggaggagccaagat

SEQ ID NO: 20172 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ccaaagcctactatgcacag

SEQ ID NO: 20173 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cactgacagtctcttaacca

SEQ ID NO: 20174 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctgtcagctgcaggcctggg

SEQ ID NO: 20175 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctatctcactgccttcttga

SEQ ID NO: 20176 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ccaaaatacagaactttcct

SEQ ID NO: 20177 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tgaaattcctcaaaaaaact

SEQ ID NO: 20178 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aggatcaagtggtggtttct

SEQ ID NO: 20179 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggcaggtatgcttttgaaat

SEQ ID NO: 20180 - DNA, 20 bp, Artificial Sequence
  Description of Artificial Sequence: Synthetic oligonucleotide
  Target: ATXN1; (+) strand; PAM type: NNGRRT; PAM sequence: ATGAGT
agatgagaccccaggaggtc

SEQ ID NO: 20181 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gctaaccacagcccagctag

SEQ ID NO: 20182 - DNA, 20 bp, Artificial Sequence
  Description of Artificial Sequence: Synthetic oligonucleotide
  Target: ATXN1; (+) strand; PAM type: NNGRRT; PAM sequence: ATGGGT
acattctcatgcctctgctc

SEQ ID NO: 20183 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ttactgaacttttctaatcc

SEQ ID NO: 20184 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gctttagattcaagtaagct

SEQ ID NO: 20185 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggcgggcagatcacgaggtg

SEQ ID NO: 20186 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgggaggctgaggcag

SEQ ID NO: 20187 - DNA, 20 bp, Artificial Sequence
  Description of Artificial Sequence: Synthetic oligonucleotide
  Target: ATXN1; (+) strand; PAM type: NNGRRT; PAM sequence: GTGAGT
cccgggaggcggaggttgta

SEQ ID NO: 20188 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tggcgccactgcactccagc

SEQ ID NO: 20189 - DNA, 20 bp, Artificial Sequence
  Description of Artificial Sequence: Synthetic oligonucleotide
  Target: ATXN1; (+) strand; PAM type: NNGRRT; PAM sequence: GAGAGT
atttgacttccttttgcctt

SEQ ID NO: 20190 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttctttaggctgtaagacta

SEQ ID NO: 20191 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttaggctgtaagactactga

SEQ ID NO: 20192 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aacatagaagcaaaattgaa

SEQ ID NO: 20193 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gtgcaatgacatgactagcc

SEQ ID NO: 20194 - DNA, 20 bp, Artificial Sequence
  Description of Artificial Sequence: Synthetic oligonucleotide
  Target: ATXN1; (+) strand; PAM type: NNGRRT; PAM sequence: AAGAGT
actagcccaggatcagtatt

SEQ ID NO: 20195 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ctactccttattttaaatat

SEQ ID NO: 20196 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ggcaatggtaattctcacct

SEQ ID NO: 20197 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gccccactgagagctttgct

SEQ ID NO: 20198 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ctcatacactgcactgcctt

SEQ ID NO: 20199 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ctgcactgcctttgggatgc

SEQ ID NO: 20200 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ccttctctctagtttagaac

SEQ ID NO: 20201 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aacttgggttgttagactcc

SEQ ID NO: 20202 - DNA, 20 bp, Artificial Sequence
  Description of Artificial Sequence: Synthetic oligonucleotide
  Target: ATXN1; (+) strand; PAM type: NNGRRT; PAM sequence: TTGGAT
cttctctccctgttttcagt

SEQ ID NO: 20203 - DNA, 20 bp, Artificial Sequence
  Description of Artificial Sequence: Synthetic oligonucleotide
  Target: ATXN1; (+) strand; PAM type: NNGRRT; PAM sequence: AGGAGT
aacaagacaacatagattca

SEQ ID NO: 20204 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gcaatgaagatggaacagca

SEQ ID NO: 20205 - DNA, 20 bp, Artificial Sequence
  Description of Artificial Sequence: Synthetic oligonucleotide
  Target: ATXN1; (+) strand; PAM type: NNGRRT; PAM sequence: GGGAGT
caggtgaaccatctgaggtt

SEQ ID NO: 20206 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ttgagatcagcctggacaac

SEQ ID NO: 20207 - DNA, 20 bp, Artificial Sequence
  Description of Artificial Sequence: Synthetic oligonucleotide
  Target: ATXN1; (+) strand; PAM type: NNGRRT; PAM sequence: GAGAAT
taatcaggaggctgaggcag

SEQ ID NO: 20208 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttgcgtcactgcactccagc

SEQ ID NO: 20209 - DNA, 20 bp, Artificial Sequence
  Description of Artificial Sequence: Synthetic oligonucleotide
  Target: ATXN1; (+) strand; PAM type: NNGRRT; PAM sequence: TTGAAT
taaaaaaaagaagctcttct

SEQ ID NO: 20210 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tctcaaacatggctgcccat

SEQ ID NO: 20211 - DNA, 20 bp, Artificial Sequence
  Description of Artificial Sequence: Synthetic oligonucleotide
  Target: ATXN1; (+) strand; PAM type: NNGRRT; PAM sequence: CTGGAT
atttgcagtctctaatggcc

SEQ ID NO: 20212 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ttttaaaaacatttccccca

SEQ ID NO: 20213 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ggattctgatcagttaggtt

SEQ ID NO: 20214 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tttaagtataactatgattc

SEQ ID NO: 20215 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gttatctgtttttttcttca

SEQ ID NO: 20216 - DNA, 20 bp, Artificial Sequence
  Description of Artificial Sequence: Synthetic oligonucleotide
  Target: ATXN1; (+) strand; PAM type: NNGRRT; PAM sequence: GAGAGT
aaggcaaacaactggcaaga

SEQ ID NO: 20217 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ggcaagagagagttttcagg

SEQ ID NO: 20218 - DNA, 20 bp, Artificial Sequence
  Description of Artificial Sequence: Synthetic oligonucleotide
  Target: ATXN1; (+) strand; PAM type: NNGRRT; PAM sequence: GTGGAT
ggaagaggctgtgcaaggtg

SEQ ID NO: 20219 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aaatccagcagtcaggttac

SEQ ID NO: 20220 - DNA, 20 bp, Artificial Sequence
  Description of Artificial Sequence: Synthetic oligonucleotide
  Target: ATXN1; (+) strand; PAM type: NNGRRT; PAM sequence: CTGGGT
caggaggcagagaaacagag

SEQ ID NO: 20221 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ggcttccccagctgataccc

SEQ ID NO: 20222 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gacctgaccttagtagcaaa

SEQ ID NO: 20223 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ctgattttctcccctcctgt

SEQ ID NO: 20224 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tctcccctcctgttaggatc

SEQ ID NO: 20225 - DNA, 20 bp, Artificial Sequence
  Description of Artificial Sequence: Synthetic oligonucleotide
  Target: ATXN1; (+) strand; PAM type: NNGRRT; PAM sequence: TGGAGT
attcttttttttttttgaga

SEQ ID NO: 20226 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttttgctctatagcccaggt

SEQ ID NO: 20227 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gattctcctgcctcagcctc

SEQ ID NO: 20228 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcctgagtagc

SEQ ID NO: 20229 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttttgtatttttagtagaga

SEQ ID NO: 20230 - DNA, 20 bp, Artificial Sequence
  Description of Artificial Sequence: Synthetic oligonucleotide
  Target: ATXN1; (+) strand; PAM type: NNGRRT; PAM sequence: GTGAGT
acaagacagtggttctcaaa

SEQ ID NO: 20231 - DNA, 20 bp, Artificial Sequence
  Description of Artificial Sequence: Synthetic oligonucleotide
  Target: ATXN1; (+) strand; PAM type: NNGRRT; PAM sequence: TCGAGT
aagaccttcagacattttat

SEQ ID NO: 20232 - DNA, 20 bp, Artificial Sequence
  Description of Artificial Sequence: Synthetic oligonucleotide
  Target: ATXN1; (+) strand; PAM type: NNGRRT; PAM sequence: ACGAAT
cacaaaatagtgtatgactt

SEQ ID NO: 20233 - DNA, 20 bp, Artificial Sequence
  Description of Artificial Sequence: Synthetic oligonucleotide
  Target: ATXN1; (+) strand; PAM type: NNGRRT; PAM sequence: AAGAAT
acttacgaatgatcacagag

SEQ ID NO: 20234 - DNA, 20 bp, Artificial Sequence
  Description of Artificial Sequence: Synthetic oligonucleotide
  Target: ATXN1; (+) strand; PAM type: NNGRRT; PAM sequence: CAGGGT
atatttattttttttagaga

SEQ ID NO: 20235 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tttttagagacagggtcttt

SEQ ID NO: 20236 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aatcctcccacatcagcctc

SEQ ID NO: 20237 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ttttaaatttttttgtagag

SEQ ID NO: 20238 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cttttttgcccaggccggtc

SEQ ID NO: 20239 - DNA, 20 bp, Artificial Sequence
  Description of Artificial Sequence: Synthetic oligonucleotide
  Target: ATXN1; (+) strand; PAM type: NNGRRT; PAM sequence: TGGAAT
accttggccttccaaagtgt

SEQ ID NO: 20240 - DNA, 20 bp, Artificial Sequence
  Description of Artificial Sequence: Synthetic oligonucleotide
  Target: ATXN1; (+) strand; PAM type: NNGRRT; PAM sequence: GTGAGT
aaccatcatgatggttcata

SEQ ID NO: 20241 - DNA, 20 bp, Artificial Sequence
  Description of Artificial Sequence: Synthetic oligonucleotide
  Target: ATXN1; (+) strand; PAM type: NNGRRT; PAM sequence: CTGAAT
atgacatatgaccagtgtgt

SEQ ID NO: 20242 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actttgggaggccaaggtgg

SEQ ID NO: 20243 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggtgggaggatcacgaggtc

SEQ ID NO: 20244 - DNA, 20 bp, Artificial Sequence
  Description of Artificial Sequence: Synthetic oligonucleotide
  Target: ATXN1; (+) strand; PAM type: NNGRRT; PAM sequence: TGGGAT
agtgtaataccttttcaaca

SEQ ID NO: 20245 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttcaacatgggattctaaca

SEQ ID NO: 20246 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ctatgcttggtccaaatatc

SEQ ID NO: 20247 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ccgatgcctaacacacatct

SEQ ID NO: 20248 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ctgtgttcctaactaggcct

SEQ ID NO: 20249 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ccttcccggtcacgtgcatc

SEQ ID NO: 20250 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ccattttttcccgaaccctt

SEQ ID NO: 20251 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaataaataaatctcttctt

SEQ ID NO: 20252 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ctcttcttgggaatattttc

SEQ ID NO: 20253 - DNA, 20 bp, Artificial Sequence
  Description of Artificial Sequence: Synthetic oligonucleotide
  Target: ATXN1; (+) strand; PAM type: NNGRRT; PAM sequence: TAGAGT
aatttcttatatttatgggc

SEQ ID NO: 20254 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tcttttaagtaactaaaaag

SEQ ID NO: 20255 - DNA, 20 bp, Artificial Sequence
  Description of Artificial Sequence: Synthetic oligonucleotide
  Target: ATXN1; (+) strand; PAM type: NNGRRT; PAM sequence: GAGAAT
agccaaagagatatgcagta

SEQ ID NO: 20256 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gcagtagagaatgtgagacc

SEQ ID NO: 20257 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cattttccacgctggctttc

SEQ ID NO: 20258 - DNA, 20 bp, Artificial Sequence
  Description of Artificial Sequence: Synthetic oligonucleotide
  Target: ATXN1; (+) strand; PAM type: NNGRRT; PAM sequence: GCGGAT
ttaaaaactcctgaggcgag

SEQ ID NO: 20259 - DNA, 20 bp, Artificial Sequence
  Description of Artificial Sequence: Synthetic oligonucleotide
  Target: ATXN1; (+) strand; PAM type: NNGRRT; PAM sequence: GGGAGT
aggcggatcacccgagatcg

SEQ ID NO: 20260 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcag

SEQ ID NO: 20261 - DNA, 20 bp, Artificial Sequence
  Description of Artificial Sequence: Synthetic oligonucleotide
  Target: ATXN1; (+) strand; PAM type: NNGRRT; PAM sequence: GTGGAT
taattacatctacttgtata

SEQ ID NO: 20262 - DNA, 20 bp, Artificial Sequence
  Description of Artificial Sequence: Synthetic oligonucleotide
  Target: ATXN1; (+) strand; PAM type: NNGRRT; PAM sequence: TTGGGT
catgcaccacataacaacat

SEQ ID NO: 20263 - DNA, 20 bp, Artificial Sequence
  Description of Artificial Sequence: Synthetic oligonucleotide
  Target: ATXN1; (+) strand; PAM type: NNGRRT; PAM sequence: GCGGAT
taacaacatttgggtcagcc

SEQ ID NO: 20264 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tatactttttattgttattt

SEQ ID NO: 20265 - DNA, 20 bp, Artificial Sequence
  Description of Artificial Sequence: Synthetic oligonucleotide
  Target: ATXN1; (+) strand; PAM type: NNGRRT; PAM sequence: TCGGGT
gtgcctgtaatctcagctct

SEQ ID NO: 20266 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tcttcgggtggctgaggcag

SEQ ID NO: 20267 - DNA, 20 bp, Artificial Sequence
  Description of Artificial Sequence: Synthetic oligonucleotide
  Target: ATXN1; (+) strand; PAM type: NNGRRT; PAM sequence: GGGAGT
cagaagaatcacttgaacca

SEQ ID NO: 20268 - DNA, 20 bp, Artificial Sequence
  Description of Artificial Sequence: Synthetic oligonucleotide
  Target: ATXN1; (+) strand; PAM type: NNGRRT; PAM sequence: CTGGAT
aataagaaaaagcttataaa

SEQ ID NO: 20269 - DNA, 20 bp, Artificial Sequence
  Description of Artificial Sequence: Synthetic oligonucleotide
  Target: ATXN1; (+) strand; PAM type: NNGRRT; PAM sequence: GAGGAT
attttgggaggctgaggcag

SEQ ID NO: 20270 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ggcaggaggatggcttgagc

SEQ ID NO: 20271 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tttctacaaaaacaagctta

SEQ ID NO: 20272 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aaatgtgtttgtattttaaa

SEQ ID NO: 20273 - DNA, 20 bp, Artificial Sequence
  Description of Artificial Sequence: Synthetic oligonucleotide
  Target: ATXN1; (+) strand; PAM type: NNGRRT; PAM sequence: TGGGGT
agtccttataaagtctacag

SEQ ID NO: 20274 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gtattcagtacagtaaggtg

SEQ ID NO: 20275 - DNA, 20 bp, Artificial Sequence
  Description of Artificial Sequence: Synthetic oligonucleotide
  Target: ATXN1; (+) strand; PAM type: NNGRRT; PAM sequence: TTGGGT
gcaggctgtaccatctaggc

SEQ ID NO: 20276 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tatttgcagaaggacgatgt

SEQ ID NO: 20277 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cgatgtaaggatgcatttct

SEQ ID NO: 20278 - DNA, 20 bp, Artificial Sequence
  Description of Artificial Sequence: Synthetic oligonucleotide
  Target: ATXN1; (+) strand; PAM type: NNGRRT; PAM sequence: GAGAGT
agtttgaaattagtcacagt

SEQ ID NO: 20279 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcgttctgtcatccaggc

SEQ ID NO: 20280 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gattctcctgcttcagcctc

SEQ ID NO: 20281 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gcttcagcctcccgagtagc

SEQ ID NO: 20282 - DNA, 20 bp, Artificial Sequence
  Description of Artificial Sequence: Synthetic oligonucleotide
  Target: ATXN1; (+) strand; PAM type: NNGRRT; PAM sequence: TGGGGT
atttatatttttagtagaga

SEQ ID NO: 20283 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tagaactaggggagaacagt

SEQ ID NO: 20284 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gccaccaaatcattgctgtc

SEQ ID NO: 20285 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gtgttggcaagaactcacac

SEQ ID NO: 20286 - DNA, 20 bp, Artificial Sequence
  Description of Artificial Sequence: Synthetic oligonucleotide
  Target: ATXN1; (+) strand; PAM type: NNGRRT; PAM sequence: CTGGAT
cttcaagaacaaaaacgcca

SEQ ID NO: 20287 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atcatccttcaccacggcca

SEQ ID NO: 20288 - DNA, 20 bp, Artificial Sequence
  Description of Artificial Sequence: Synthetic oligonucleotide
  Target: ATXN1; (+) strand; PAM type: NNGRRT; PAM sequence: ACGGAT
caccacggccacagaatttg

SEQ ID NO: 20289 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tcctcgcaaccattgctatg

SEQ ID NO: 20290 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aaatgcaaacacacttccac

SEQ ID NO: 20291 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aaattcaaatagaagtaatc

SEQ ID NO: 20292 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aatagaagtaatcgtgaata

SEQ ID NO: 20293 - DNA, 20 bp, Artificial Sequence
  Description of Artificial Sequence: Synthetic oligonucleotide
  Target: ATXN1; (+) strand; PAM type: NNGRRT; PAM sequence: TAGAGT
aatatatatgtatatgtgta

SEQ ID NO: 20294 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tgcacaaatacgtgtgtttt

SEQ ID NO: 20295 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gtttgtttttcgcctcctcc

SEQ ID NO: 20296 - DNA, 20 bp, Artificial Sequence
  Description of Artificial Sequence: Synthetic oligonucleotide
  Target: ATXN1; (+) strand; PAM type: NNGRRT; PAM sequence: AAGAAT
taaatcctgggaaaaatgtg

SEQ ID NO: 20297 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gtaaaaacacaacactgctt

SEQ ID NO: 20298 - DNA, 20 bp, Artificial Sequence
  Description of Artificial Sequence: Synthetic oligonucleotide
  Target: ATXN1; (+) strand; PAM type: NNGRRT; PAM sequence: ATGGGT
agttgaaccgattgtacaac

SEQ ID NO: 20299 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ctccgtctcacgactccagc

SEQ ID NO: 20300 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aaacccatctgtccccttgt

SEQ ID NO: 20301 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aacaaaagttaaatgtggca

SEQ ID NO: 20302 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gaaattcttagaggtcacta

SEQ ID NO: 20303 - DNA, 20 bp, Artificial Sequence
  Description of Artificial Sequence: Synthetic oligonucleotide
  Target: ATXN1; (+) strand; PAM type: NNGRRT; PAM sequence: TGGAGT
attaccctggcaagagatga

SEQ ID NO: 20304 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cattttatctcagaggtttg

SEQ ID NO: 20305 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctaaagacagaaatagcgaa

SEQ ID NO: 20306 - DNA, 20 bp, Artificial Sequence
  Description of Artificial Sequence: Synthetic oligonucleotide
  Target: ATXN1; (+) strand; PAM type: NNGRRT; PAM sequence: CCGGGT
atttttgattgtcacaactg

SEQ ID NO: 20307 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gcatccagcgcatagaggcc

SEQ ID NO: 20308 - DNA, 20 bp, Artificial Sequence
  Description of Artificial Sequence: Synthetic oligonucleotide
  Target: ATXN1; (+) strand; PAM type: NNGRRT; PAM sequence: TAGGAT
catctccctgcttccccaaa

SEQ ID NO: 20309 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gaaaagatcagctgcagcca

SEQ ID NO: 20310 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tagggagcatgtgggaaatg

SEQ ID NO: 20311 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cccacccagactgacagaac

SEQ ID NO: 20312 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aattatttccactctgccct

SEQ ID NO: 20313 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ttcaagccagttctaggtac

SEQ ID NO: 20314 - DNA, 20 bp, Artificial Sequence
  Description of Artificial Sequence: Synthetic oligonucleotide
  Target: ATXN1; (+) strand; PAM type: NNGRRT; PAM sequence: TGGAAT
atttgccctcaacccaactg

SEQ ID NO: 20315 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tggaattctccagtgactat

SEQ ID NO: 20316 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atgtggatgacatcttacac

SEQ ID NO: 20317 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ttggcactagaaggagcttc

SEQ ID NO: 20318 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tattatattattttcacttt

SEQ ID NO: 20319 - DNA, 20 bp, Artificial Sequence
  Description of Artificial Sequence: Synthetic oligonucleotide
  Target: ATXN1; (+) strand; PAM type: NNGRRT; PAM sequence: AAGAGT
agtgtccttacattaaaata

SEQ ID NO: 20320 - DNA, 20 bp, Artificial Sequence
  Description of Artificial Sequence: Synthetic oligonucleotide
  Target: ATXN1; (+) strand; PAM type: NNGRRT; PAM sequence: GAGGGT
agggacagtctggttgtagc

SEQ ID NO: 20321 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gttttgggaagctgaggcag

SEQ ID NO: 20322 - DNA, 20 bp, Artificial Sequence
  Description of Artificial Sequence: Synthetic oligonucleotide
  Target: ATXN1; (+) strand; PAM type: NNGRRT; PAM sequence: CTGGGT
taaaaatttaaaaaaaatag

SEQ ID NO: 20323 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gtcccagctactcagaggct

SEQ ID NO: 20324 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctactcagaggctgagggtg

SEQ ID NO: 20325 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cagattttgcctccattggg

SEQ ID NO: 20326 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gtgctcctggtggacacact

SEQ ID NO: 20327 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aagtactatgtttatatctc

SEQ ID NO: 20328 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tttatatctcatgagtgtaa

SEQ ID NO: 20329 - DNA, 20 bp, Artificial Sequence
  Description of Artificial Sequence: Synthetic oligonucleotide
  Target: ATXN1; (+) strand; PAM type: NNGRRT; PAM sequence: TAGGGT
aactgaatatttttcccctt

SEQ ID NO: 20330 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agggtcaagggctctgtctc

SEQ ID NO: 20331 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aggagcaagtcacatcttac

SEQ ID NO: 20332 - DNA, 20 bp, Artificial Sequence
  Description of Artificial Sequence: Synthetic oligonucleotide
  Target: ATXN1; (+) strand; PAM type: NNGRRT; PAM sequence: GGGAAT
atgagagagagcttatgcag

SEQ ID NO: 20333 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tcattaatttctctagaact

SEQ ID NO: 20334 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gggacaatgtgcataggcca

SEQ ID NO: 20335 - DNA, 20 bp, Artificial Sequence
  Description of Artificial Sequence: Synthetic oligonucleotide
  Target: ATXN1; (+) strand; PAM type: NNGRRT; PAM sequence: GAGGAT
agctgttcctcctttcaagg

SEQ ID NO: 20336 - DNA, 20 bp, Artificial Sequence
  Description of Artificial Sequence: Synthetic oligonucleotide
  Target: ATXN1; (+) strand; PAM type: NNGRRT; PAM sequence: TGGAAT
cagaggttctgggcttttta

SEQ ID NO: 20337 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gaaggtggttttaacccagt

SEQ ID NO: 20338 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tgaattcaaatctgtagata

SEQ ID NO: 20339 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aactctcttaaaacagcgct

SEQ ID NO: 20340 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atgtgcacgtgtatgtatgt

SEQ ID NO: 20341 - DNA, 20 bp, Artificial Sequence
  Description of Artificial Sequence: Synthetic oligonucleotide
  Target: ATXN1; (+) strand; PAM type: NNGRRT; PAM sequence: CAGAAT
actgggactctggcaggaac

SEQ ID NO: 20342 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atgcatcatcaccttcacgc

SEQ ID NO: 20343 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cggcttctcagctgacacat

SEQ ID NO: 20344 - DNA, 20 bp, Artificial Sequence
  Description of Artificial Sequence: Synthetic oligonucleotide
  Target: ATXN1; (+) strand; PAM type: NNGRRT; PAM sequence: CAGGGT
taaaaaaaaattttttaaga

SEQ ID NO: 20345 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactttgtcactcaggt

SEQ ID NO: 20346 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcacttcagccttgacctt

SEQ ID NO: 20347 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtagaga

SEQ ID NO: 20348 - DNA, 20 bp, Artificial Sequence
  Description of Artificial Sequence: Synthetic oligonucleotide
  Target: ATXN1; (+) strand; PAM type: NNGRRT; PAM sequence: TAGGAT
accttggcctccaaaagtgc

SEQ ID NO: 20349 - DNA, 20 bp, Artificial Sequence
  Description of Artificial Sequence: Synthetic oligonucleotide
  Target: ATXN1; (+) strand; PAM type: NNGRRT; PAM sequence: CTGAGT
atttattaccctgtcccctc

SEQ ID NO: 20350 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tgaaaaaaagcacagacagc

SEQ ID NO: 20351 - DNA, 20 bp, Artificial Sequence
  Description of Artificial Sequence: Synthetic oligonucleotide
  Target: ATXN1; (+) strand; PAM type: NNGRRT; PAM sequence: AAGAAT
actctccctgctatggttaa

SEQ ID NO: 20352 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gctatggttaaaagaattct

SEQ ID NO: 20353 - DNA, 20 bp, Artificial Sequence
  Description of Artificial Sequence: Synthetic oligonucleotide
  Target: ATXN1; (+) strand; PAM type: NNGRRT; PAM sequence: TGGGAT
attgaaaagttactgctttg

SEQ ID NO: 20354 - DNA, 20 bp, Artificial Sequence
  Description of Artificial Sequence: Synthetic oligonucleotide
  Target: ATXN1; (+) strand; PAM type: NNGRRT; PAM sequence: GAGAGT
actctgaaaatattttcttg

SEQ ID NO: 20355 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aaggtgctttgtcctttggg

SEQ ID NO: 20356 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ctgatgggactcaagagatg

SEQ ID NO: 20357 - DNA, 20 bp, Artificial Sequence
  Description of Artificial Sequence: Synthetic oligonucleotide
  Target: ATXN1; (+) strand; PAM type: NNGRRT; PAM sequence: TGGGGT
agggggcattttgacaccct

SEQ ID NO: 20358 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gcttcctgctcgacttttac

SEQ ID NO: 20359 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctttcctccagttaaggtcc

SEQ ID NO: 20360 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cactccacgttgttagtttt

SEQ ID NO: 20361 - DNA, 20 bp, Artificial Sequence
  Description of Artificial Sequence: Synthetic oligonucleotide
  Target: ATXN1; (+) strand; PAM type: NNGRRT; PAM sequence: CCGGAT
cactgttccctctttagtgg

SEQ ID NO: 20362 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tagtggccggatctcagcct

SEQ ID NO: 20363 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ctgtcggtacagcctgggga

SEQ ID NO: 20364 - DNA, 20 bp, Artificial Sequence
  Description of Artificial Sequence: Synthetic oligonucleotide
  Target: ATXN1; (+) strand; PAM type: NNGRRT; PAM sequence: TTGGGT
cttggaagatgtcctggtgt

SEQ ID NO: 20365 - DNA, 20 bp, Artificial Sequence
  Description of Artificial Sequence: Synthetic oligonucleotide
  Target: ATXN1; (+) strand; PAM type: NNGRRT; PAM sequence: TTGGGT
cagaagcaagactttctcat

SEQ ID NO: 20366 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agactttctcatttgggtct

SEQ ID NO: 20367 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cagtccctcaccttttcctg

SEQ ID NO: 20368 - DNA, 20 bp, Artificial Sequence
  Description of Artificial Sequence: Synthetic oligonucleotide
  Target: ATXN1; (+) strand; PAM type: NNGRRT; PAM sequence: TAGAGT
cctcaccttttcctggagaa

SEQ ID NO: 20369 - DNA, 20 bp, Artificial Sequence
  Description of Artificial Sequence: Synthetic oligonucleotide
  Target: ATXN1; (+) strand; PAM type: NNGRRT; PAM sequence: GTGGAT
gagtttgatatgaacattaa

SEQ ID NO: 20370 - DNA, 20 bp, Artificial Sequence
  Description of Artificial Sequence: Synthetic oligonucleotide
  Target: ATXN1; (+) strand; PAM type: NNGRRT; PAM sequence: AAGAGT
atatcacaccaataaaagcc

SEQ ID NO: 20371 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gctacaaacgactacgtagt

SEQ ID NO: 20372 - DNA, 20 bp, Artificial Sequence
  Description of Artificial Sequence: Synthetic oligonucleotide
  Target: ATXN1; (+) strand; PAM type: NNGRRT; PAM sequence: CTGGAT
agtgagagttaggaactatt

SEQ ID NO: 20373 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actgtgatgtcatgcacctt

SEQ ID NO: 20374 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gtttcataaaatgttagcgc

SEQ ID NO: 20375 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tggttgctgtggttggctgg

SEQ ID NO: 20376 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ccgcactgcagtgctcttgg

SEQ ID NO: 20377 - DNA, 20 bp, Artificial Sequence
  Description of Artificial Sequence: Synthetic oligonucleotide
  Target: ATXN1; (+) strand; PAM type: NNGRRT; PAM sequence: AGGAAT
taaaaaagtggaacatgtga

SEQ ID NO: 20378 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ccaagttaaataattttttc

SEQ ID NO: 20379 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tactcacagccaaccaataa

SEQ ID NO: 20380 - DNA, 20 bp, Artificial Sequence
  Description of Artificial Sequence: Synthetic oligonucleotide
  Target: ATXN1; (+) strand; PAM type: NNGRRT; PAM sequence: ACGGAT
gatcagttagttcaaaccta

SEQ ID NO: 20381 - DNA, 20 bp, Artificial Sequence
  Description of Artificial Sequence: Synthetic oligonucleotide
  Target: ATXN1; (+) strand; PAM type: NNGRRT; PAM sequence: AGGAAT
attttcctccccatctaatt

SEQ ID NO: 20382 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctagccattcgggacaaata

SEQ ID NO: 20383 - DNA, 20 bp, Artificial Sequence
  Description of Artificial Sequence: Synthetic oligonucleotide
  Target: ATXN1; (+) strand; PAM type: NNGRRT; PAM sequence: TAGGGT
atggaaactggacatagcag

SEQ ID NO: 20384 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aacacttaagatgtgtacta

SEQ ID NO: 20385 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aatgggcatgcctgagatca

SEQ ID NO: 20386 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ttttttaaatgttctcctct

SEQ ID NO: 20387 - DNA, 20 bp, Artificial Sequence
  Description of Artificial Sequence: Synthetic oligonucleotide
  Target: ATXN1; (+) strand; PAM type: NNGRRT; PAM sequence: CGGAAT
atgattcaaaataatatggt

SEQ ID NO: 20388 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttcaaaataatatggtcgga

SEQ ID NO: 20389 - DNA, 20 bp, Artificial Sequence
  Description of Artificial Sequence: Synthetic oligonucleotide
  Target: ATXN1; (+) strand; PAM type: NNGRRT; PAM sequence: AAGGAT
atatggtcggaatgaatggg

SEQ ID NO: 20390 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctcatagtaaggctgtccta

SEQ ID NO: 20391 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aaaagtatctgtatcaactt

SEQ ID NO: 20392 - DNA, 20 bp, Artificial Sequence
  Description of Artificial Sequence: Synthetic oligonucleotide
  Target: ATXN1; (+) strand; PAM type: NNGRRT; PAM sequence: TGGAGT
aattcccaggggcacagttg

SEQ ID NO: 20393 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tgtagctagaagccccattg

SEQ ID NO: 20394 - DNA, 20 bp, Artificial Sequence
  Description of Artificial Sequence: Synthetic oligonucleotide
  Target: ATXN1; (+) strand; PAM type: NNGRRT; PAM sequence: CTGGAT
caggtctcatctgggcatct

SEQ ID NO: 20395 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctgggcatctctggatacgt

SEQ ID NO: 20396 - DNA, 20 bp, Artificial Sequence
  Description of Artificial Sequence: Synthetic oligonucleotide
  Target: ATXN1; (+) strand; PAM type: NNGRRT; PAM sequence: GTGGAT
acgtctgggtggcctgtgaa

SEQ ID NO: 20397 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ctgggtggcctgtgaagtgg

SEQ ID NO: 20398 - DNA, 20 bp, Artificial Sequence
  Description of Artificial Sequence: Synthetic oligonucleotide
  Target: ATXN1; (+) strand; PAM type: NNGRRT; PAM sequence: AGGGAT
gcagtgacaggaaacctgcc

SEQ ID NO: 20399 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gtgtgaggaaggaactgacc

SEQ ID NO: 20400 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aaggaactgacccagagtgg

SEQ ID NO: 20401 - DNA, 20 bp, Artificial Sequence
  Description of Artificial Sequence: Synthetic oligonucleotide
  Target: ATXN1; (+) strand; PAM type: NNGRRT; PAM sequence: CGGGAT
aggtgcatctgctaggcatg

SEQ ID NO: 20402 - DNA, 20 bp, Artificial Sequence
  Description of Artificial Sequence: Synthetic oligonucleotide
  Target: ATXN1; (+) strand; PAM type: NNGRRT; PAM sequence: GGGGGT
gcatgcgggattgggggcat

SEQ ID NO: 20403 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gcatgggggtgtcaacaaca

SEQ ID NO: 20404 - DNA, 20 bp, Artificial Sequence
  Description of Artificial Sequence: Synthetic oligonucleotide
  Target: ATXN1; (+) strand; PAM type: NNGRRT; PAM sequence: AGGAAT
acaacaggggatataacatt

SEQ ID NO: 20405 - DNA, 20 bp, Artificial Sequence
  Description of Artificial Sequence: Synthetic oligonucleotide
  Target: ATXN1; (+) strand; PAM type: NNGRRT; PAM sequence: AGGGGT
accaacccagccccttgggg

SEQ ID NO: 20406 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gaagagaactttcaccactc

SEQ ID NO: 20407 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tgacatcacagggcagaaac

SEQ ID NO: 20408 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ttgataataacattcgagaa

SEQ ID NO: 20409 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgagaaccctggaagaagat

SEQ ID NO: 20410 - DNA, 20 bp, Artificial Sequence
  Description of Artificial Sequence: Synthetic oligonucleotide
  Target: ATXN1; (+) strand; PAM type: NNGRRT; PAM sequence: GAGGAT
atgagaatgaggaacatgat

SEQ ID NO: 20411 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tttgtcacttacaacctttt

SEQ ID NO: 20412 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gttttaatgataaggaaagt

SEQ ID NO: 20413 - DNA, 20 bp, Artificial Sequence
  Description of Artificial Sequence: Synthetic oligonucleotide
  Target: ATXN1; (+) strand; PAM type: NNGRRT; PAM sequence: TAGAGT
attttaaaaaacctgttttt

SEQ ID NO: 20414 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ggtctctgtcatccaggctg

SEQ ID NO: 20415 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcactgcagcctcaatctc

SEQ ID NO: 20416 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gatcctcctgtctcagtctg

SEQ ID NO: 20417 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tgctgagtagctgggactac

SEQ ID NO: 20418 - DNA, 20 bp, Artificial Sequence
  Description of Artificial Sequence: Synthetic oligonucleotide
  Target: ATXN1; (+) strand; PAM type: NNGRRT; PAM sequence: GAGGGT
attcttaccttggcacccaa

SEQ ID NO: 20419 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttggtgactgaacaaataaa

SEQ ID NO: 20420 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tgaacaaataaaaagaatac

SEQ ID NO: 20421 - DNA, 20 bp, Artificial Sequence
  Description of Artificial Sequence: Synthetic oligonucleotide
  Target: ATXN1; (+) strand; PAM type: NNGRRT; PAM sequence: CAGGAT
attataatcaaataatgtca

SEQ ID NO: 20422 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aggatcgatatttcctgcta

SEQ ID NO: 20423 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggcagaggcag

SEQ ID NO: 20424 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggtggatcacttaaggtc

SEQ ID NO: 20425 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tactcgggaggctgaggcag

SEQ ID NO: 20426 - DNA, 20 bp, Artificial Sequence
  Description of Artificial Sequence: Synthetic oligonucleotide
  Target: ATXN1; (+) strand; PAM type: NNGRRT; PAM sequence: TAGAGT
ctgcattccagcctgggcaa

SEQ ID NO: 20427 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tttaaaagcttccagacgtg

SEQ ID NO: 20428 - DNA, 20 bp, Artificial Sequence
  Description of Artificial Sequence: Synthetic oligonucleotide
  Target: ATXN1; (+) strand; PAM type: NNGRRT; PAM sequence: GCGAGT
tggtttgcggcttttaaaca

SEQ ID NO: 20429 - DNA, 20 bp, Artificial Sequence
  Description of Artificial Sequence: Synthetic oligonucleotide
  Target: ATXN1; (+) strand; PAM type: NNGRRT; PAM sequence: GCGGGT
ctgggctgatgatgctggtt

SEQ ID NO: 20430 - DNA, 20 bp, Artificial Sequence
  Description of Artificial Sequence: Synthetic oligonucleotide
  Target: ATXN1; (+) strand; PAM type: NNGRRT; PAM sequence: TTGAGT
agcgaaaacaaggaacagat

SEQ ID NO: 20431 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ccgtcgtgataggcttggca

SEQ ID NO: 20432 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gcttggcagaggatgaagca

SEQ ID NO: 20433 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gggtggcaccggagccctac

SEQ ID NO: 20434 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cttgcttactatgacgccgt

SEQ ID NO: 20435 - DNA, 20 bp, Artificial Sequence
  Description of Artificial Sequence: Synthetic oligonucleotide
  Target: ATXN1; (+) strand; PAM type: NNGRRT; PAM sequence: AGGAAT
taattgacatctctttctga

SEQ ID NO: 20436 - DNA, 20 bp, Artificial Sequence
  Description of Artificial Sequence: Synthetic oligonucleotide
  Target: ATXN1; (+) strand; PAM type: NNGRRT; PAM sequence: GGGAGT
acttacaaaggtgaggagca

SEQ ID NO: 20437 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ttctttcctaatgcttgcac

SEQ ID NO: 20438 - DNA, 20 bp, Artificial Sequence
  Description of Artificial Sequence: Synthetic oligonucleotide
  Target: ATXN1; (+) strand; PAM type: NNGRRT; PAM sequence: ACGAAT
tgcttgcactgggatttctg

SEQ ID NO: 20439 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tgatttgtctaaacctgttt

SEQ ID NO: 20440 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ataatatgcaaaaaatccaa

SEQ ID NO: 20441 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ggtgcaatcatttgttttac

SEQ ID NO: 20442 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ccaatgaactacaagcttgt

SEQ ID NO: 20443 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tacaacatccgtggagcaaa

SEQ ID NO: 20444 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttagtgtagcagtacgtatt

SEQ ID NO: 20445 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gtgctaaagatggaaaatag

SEQ ID NO: 20446 - DNA, 20 bp, Artificial Sequence
  Description of Artificial Sequence: Synthetic oligonucleotide
  Target: ATXN1; (+) strand; PAM type: NNGRRT; PAM sequence: GCGGAT
tctttgggaggccaatgcag

SEQ ID NO: 20447 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggcggatcacttgaggcc

SEQ ID NO: 20448 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggaggctgaggcag

SEQ ID NO: 20449 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcacaccacggcactccagc

SEQ ID NO: 20450 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cggcactccagcctgggtga

SEQ ID NO: 20451 - DNA, 20 bp, Artificial Sequence
  Description of Artificial Sequence: Synthetic oligonucleotide
  Target: ATXN1; (+) strand; PAM type: NNGRRT; PAM sequence: TTGAAT
atatgactttaatattgata

SEQ ID NO: 20452 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ggtggtactcagagaaggcc

SEQ ID NO: 20453 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aaaaatctccctggctgcat

SEQ ID NO: 20454 - DNA, 20 bp, Artificial Sequence
  Description of Artificial Sequence: Synthetic oligonucleotide
  Target: ATXN1; (+) strand; PAM type: NNGRRT; PAM sequence: AAGGAT
taagacattggggagaaaga

SEQ ID NO: 20455 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gagggaacaagggcaaagat

SEQ ID NO: 20456 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gaggatcattgaagacgttc

SEQ ID NO: 20457 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atagctggcctgggggagaa

SEQ ID NO: 20458 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gaaatgaatgtcaccgtagt

SEQ ID NO: 20459 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gtcagcttcttgaggttatc

SEQ ID NO: 20460 - DNA, 20 bp, Artificial Sequence
  Description of Artificial Sequence: Synthetic oligonucleotide
  Target: ATXN1; (+) strand; PAM type: NNGRRT; PAM sequence: TTGGAT
taagggcagtaaaaatgcca

SEQ ID NO: 20461 - DNA, 20 bp, Artificial Sequence
  Description of Artificial Sequence: Synthetic oligonucleotide
  Target: ATXN1; (+) strand; PAM type: NNGRRT; PAM sequence: ACGGAT
aggcaaattctgaggttgta

SEQ ID NO: 20462 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttaatataaatgttgattca

SEQ ID NO: 20463 - DNA, 20 bp, Artificial Sequence
  Description of Artificial Sequence: Synthetic oligonucleotide
  Target: ATXN1; (+) strand; PAM type: NNGRRT; PAM sequence: TAGAAT
attcactgaattgtgaacta

SEQ ID NO: 20464 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tctttgttgtgcatgttttt

SEQ ID NO: 20465 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tgcgtgtcccttatcatcta

SEQ ID NO: 20466 - DNA, 20 bp, Artificial Sequence
  Description of Artificial Sequence: Synthetic oligonucleotide
  Target: ATXN1; (+) strand; PAM type: NNGRRT; PAM sequence: TAGGAT
aaggagctaattaaatctcc

SEQ ID NO: 20467 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cccacaccctaagaaatttg

SEQ ID NO: 20468 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ttccaaattccccaaaggtc

SEQ ID NO: 20469 - DNA, 20 bp, Artificial Sequence
  Description of Artificial Sequence: Synthetic oligonucleotide
  Target: ATXN1; (+) strand; PAM type: NNGRRT; PAM sequence: CAGAGT
caatggaacaatggcatccc

SEQ ID NO: 20470 - DNA, 20 bp, Artificial Sequence
  Description of Artificial Sequence: Synthetic oligonucleotide
  Target: ATXN1; (+) strand; PAM type: NNGRRT; PAM sequence: GAGAGT
cagagtgactgccttgggga

SEQ ID NO: 20471 - DNA, 20 bp, Artificial Sequence
  Description of Artificial Sequence: Synthetic oligonucleotide
  Target: ATXN1; (+) strand; PAM type: NNGRRT; PAM sequence: GTGGAT
gagctgcaagcatcatcaaa

SEQ ID NO: 20472 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gtcctatagttttctagtgt

SEQ ID NO: 20473 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tatctattcacaagaagaaa

SEQ ID NO: 20474 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aatgatacagttagcacatt

SEQ ID NO: 20475 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cagttagcacattatggatg

SEQ ID NO: 20476 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttgtgtgcagcaaatgttta

SEQ ID NO: 20477 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gtgcagcaaatgtttaatga

SEQ ID NO: 20478 - DNA, 20 bp, Artificial Sequence
  Description of Artificial Sequence: Synthetic oligonucleotide
  Target: ATXN1; (+) strand; PAM type: NNGRRT; PAM sequence: ATGAGT
agcaaatgtttaatgaatgg

SEQ ID NO: 20479 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aatgtttaatgaatggatga

SEQ ID NO: 20480 - DNA, 20 bp, Artificial Sequence
  Description of Artificial Sequence: Synthetic oligonucleotide
  Target: ATXN1; (+) strand; PAM type: NNGRRT; PAM sequence: GTGAAT
taatgaatggatgagtgaat

SEQ ID NO: 20481 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ggatgagtgaatgtgaatca

SEQ ID NO: 20482 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gaatgtgaatcaatgggtgg

SEQ ID NO: 20483 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gtgggggaataaataaataa

SEQ ID NO: 20484 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gggaataaataaataaatga

SEQ ID NO: 20485 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctgacgagcccatactggga

SEQ ID NO: 20486 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tgagctttgtgacatgatgt

SEQ ID NO: 20487 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gaagacaaaatttcctttga

SEQ ID NO: 20488 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aggtggttatttggggaaac

SEQ ID NO: 20489 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aaatcaaacattgctctact

SEQ ID NO: 20490 - DNA, 20 bp, Artificial Sequence
  Description of Artificial Sequence: Synthetic oligonucleotide
  Target: ATXN1; (+) strand; PAM type: NNGRRT; PAM sequence: GAGGAT
taaaagtgatgcttaatttg

SEQ ID NO: 20491 - DNA, 20 bp, Artificial Sequence
  Description of Artificial Sequence: Synthetic oligonucleotide
  Target: ATXN1; (+) strand; PAM type: NNGRRT; PAM sequence: ACGGAT
gttagacacttggtacagga

SEQ ID NO: 20492 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tcgagccaactgaactatca

SEQ ID NO: 20493 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gccttcattctctctccact

SEQ ID NO: 20494 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cataatgaaacactaatccc

SEQ ID NO: 20495 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gtgtgacgcccacgacacaa

SEQ ID NO: 20496 - DNA, 20 bp, Artificial Sequence
  Description of Artificial Sequence: Synthetic oligonucleotide
  Target: ATXN1; (+) strand; PAM type: NNGRRT; PAM sequence: TTGAGT
cttcactcaggcctttttat

SEQ ID NO: 20497 - DNA, 20 bp, Artificial Sequence
  Description of Artificial Sequence: Synthetic oligonucleotide
  Target: ATXN1; (+) strand; PAM type: NNGRRT; PAM sequence: CCGAAT
ttttatttgagtttatctat

SEQ ID NO: 20498 - DNA, 20 bp, Artificial Sequence
  Description of Artificial Sequence: Synthetic oligonucleotide
  Target: ATXN1; (+) strand; PAM type: NNGRRT; PAM sequence: GAGAAT
acaatttgtagcatctgaaa

SEQ ID NO: 20499 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tactcaatatgttggtggac

SEQ ID NO: 20500 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ttaataaaagtatacaattt

SEQ ID NO: 20501 - DNA, 20 bp, Artificial Sequence
  Description of Artificial Sequence: Synthetic oligonucleotide
  Target: ATXN1; (+) strand; PAM type: NNGRRT; PAM sequence: CTGGAT
atggactaaaagttgagcta

SEQ ID NO: 20502 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aaaatgtcacttataattag

SEQ ID NO: 20503 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gaagcacccactttcctagc

SEQ ID NO: 20504 - DNA, 20 bp, Artificial Sequence
  Description of Artificial Sequence: Synthetic oligonucleotide
  Target: ATXN1; (+) strand; PAM type: NNGRRT; PAM sequence: TGGAAT
agaaattattttaaaatata

SEQ ID NO: 20505 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tgtttttggtttttttgaga

SEQ ID NO: 20506 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcgcccagac

SEQ ID NO: 20507 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcactgcaacctctgcctc

SEQ ID NO: 20508 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gattctcctgcctcagcctc

SEQ ID NO: 20509 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttaggagaga

SEQ ID NO: 20510 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tggggtttggccatgttggc

SEQ ID NO: 20511 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tccttggcctcccaaagtgc

SEQ ID NO: 20512 - DNA, 20 bp, Artificial Sequence
  Description of Artificial Sequence: Synthetic oligonucleotide
  Target: ATXN1; (+) strand; PAM type: NNGRRT; PAM sequence: GTGAGT
agtagcagagaaagggacct

SEQ ID NO: 20513 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gcagagaaagggacctgtga

SEQ ID NO: 20514 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tctggcgaagacaaagtaaa

SEQ ID NO: 20515 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ctcattcattctgcggttat

SEQ ID NO: 20516 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttcatgctgtaggtagggaa

SEQ ID NO: 20517 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atcgtttttttccctccctt

SEQ ID NO: 20518 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tttttttccctcccttcaga

SEQ ID NO: 20519 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctcccttcagaatgagtggg

SEQ ID NO: 20520 - DNA, 20 bp, Artificial Sequence
  Description of Artificial Sequence: Synthetic oligonucleotide
  Target: ATXN1; (+) strand; PAM type: NNGRRT; PAM sequence: CAGGAT
atataagtcaataatgcaaa

SEQ ID NO: 20521 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gtttctggaaagtaatgtct

SEQ ID NO: 20522 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aatgcaacttattttcttag

SEQ ID NO: 20523 - DNA, 20 bp, Artificial Sequence
  Description of Artificial Sequence: Synthetic oligonucleotide
  Target: ATXN1; (+) strand; PAM type: NNGRRT; PAM sequence: CTGAAT
atccaatacctctgacccct

SEQ ID NO: 20524 - DNA, 20 bp, Artificial Sequence
  Description of Artificial Sequence: Synthetic oligonucleotide
  Target: ATXN1; (+) strand; PAM type: NNGRRT; PAM sequence: TGGAAT
acagccgagctggtacacac

SEQ ID NO: 20525 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gctggtacacactggaattc

SEQ ID NO: 20526 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gtgtatcattgcatactcag

SEQ ID NO: 20527 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aggcttttaataagtattta

SEQ ID NO: 20528 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ttttaataagtatttattga

SEQ ID NO: 20529 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ttgaatggatacatgaagat

SEQ ID NO: 20530 - DNA, 20 bp, Artificial Sequence
  Description of Artificial Sequence: Synthetic oligonucleotide
  Target: ATXN1; (+) strand; PAM type: NNGRRT; PAM sequence: GTGAAT
atggatacatgaagatatga

SEQ ID NO: 20531 - DNA, 20 bp, Artificial Sequence
  Description of Artificial Sequence: Synthetic oligonucleotide
  Target: ATXN1; (+) strand; PAM type: NNGRRT; PAM sequence: TGGAAT
atgaagatatgagtgaataa

SEQ ID NO: 20532 - DNA, 20 bp, Artificial Sequence
  Description of Artificial Sequence: Synthetic oligonucleotide
  Target: ATXN1; (+) strand; PAM type: NNGRRT; PAM sequence: CAGGGT
aaaaaaattttcttttgaga

SEQ ID NO: 20533 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaagtcac

SEQ ID NO: 20534 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttatggcttttaatggaaag

SEQ ID NO: 20535 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tacttcatcaagtagagaga

SEQ ID NO: 20536 - DNA, 20 bp, Artificial Sequence
  Description of Artificial Sequence: Synthetic oligonucleotide
  Target: ATXN1; (+) strand; PAM type: NNGRRT; PAM sequence: CGGAGT
attttttttttttcttgaga

SEQ ID NO: 20537 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gattgtcctgcctcagcctc

SEQ ID NO: 20538 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttttgtatatttactagaga

SEQ ID NO: 20539 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cggggtttcgccatattagc

SEQ ID NO: 20540 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tgaggttaaaaactatgaga

SEQ ID NO: 20541 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gttaaaaactatgagaagga

SEQ ID NO: 20542 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aaaactatgagaaggaatgg

SEQ ID NO: 20543 - DNA, 20 bp, Artificial Sequence
  Description of Artificial Sequence: Synthetic oligonucleotide
  Target: ATXN1; (+) strand; PAM type: NNGRRT; PAM sequence: ACGAAT
aggaatggatgagtaaatca

SEQ ID NO: 20544 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gtaaagcatgttgtttgaga

SEQ ID NO: 20545 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttaaaatgctcattaaatga

SEQ ID NO: 20546 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttaatgcataacccttccta

SEQ ID NO: 20547 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tccttgcatttgtacagaaa

SEQ ID NO: 20548 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caactccctctgtggctttc

SEQ ID NO: 20549 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tttcaggaatgcttagcctt

SEQ ID NO: 20550 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tagaaagtacagaaatccac

SEQ ID NO: 20551 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ggcacatgtcaaatcaaaga

SEQ ID NO: 20552 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ccccaccccacaacagtccc

SEQ ID NO: 20553 - DNA, 20 bp, Artificial Sequence
  Description of Artificial Sequence: Synthetic oligonucleotide
  Target: ATXN1; (+) strand; PAM type: NNGRRT; PAM sequence: TTGAAT
agccccaatttccttttctg

SEQ ID NO: 20554 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aatttccttttctgttgaat

SEQ ID NO: 20555 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gtattgttttcttctttgag

SEQ ID NO: 20556 - DNA, 20 bp, Artificial Sequence
  Description of Artificial Sequence: Synthetic oligonucleotide
  Target: ATXN1; (+) strand; PAM type: NNGRRT; PAM sequence: GGGAGT
cctcagccacccaagtagct

SEQ ID NO: 20557 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ataaatatttttataatatt

SEQ ID NO: 20558 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gttttcttgtgatacaacca

SEQ ID NO: 20559 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tacaaccatggagtactttc

SEQ ID NO: 20560 - DNA, 20 bp, Artificial Sequence
  Description of Artificial Sequence: Synthetic oligonucleotide
  Target: ATXN1; (+) strand; PAM type: NNGRRT; PAM sequence: GTGGGT
accatggagtactttccagg

SEQ ID NO: 20561 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gccctgggcagtgctatttt

SEQ ID NO: 20562 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aaaggtgccagggaggcctt

SEQ ID NO: 20563 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gacactgctacatgtgcatg

SEQ ID NO: 20564 - DNA, 20 bp, Artificial Sequence
  Description of Artificial Sequence: Synthetic oligonucleotide
  Target: ATXN1; (+) strand; PAM type: NNGRRT; PAM sequence: CCGGGT
tgtgcatgctgagtggctgc

SEQ ID NO: 20565 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ggtctgcctttgtgtactag

SEQ ID NO: 20566 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gggctgctgtcatcatttgg

SEQ ID NO: 20567 - DNA, 20 bp, Artificial Sequence
  Description of Artificial Sequence: Synthetic oligonucleotide
  Target: ATXN1; (+) strand; PAM type: NNGRRT; PAM sequence: ACGGAT
acctcactctcagggagggg

SEQ ID NO: 20568 - DNA, 20 bp, Artificial Sequence
  Description of Artificial Sequence: Synthetic oligonucleotide
  Target: ATXN1; (+) strand; PAM type: NNGRRT; PAM sequence: CAGGGT
accgctcatcctatcatcta

SEQ ID NO: 20569 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atctacagggtttttaaagt

SEQ ID NO: 20570 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gtgggtcctcattctctggc

SEQ ID NO: 20571 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ggtgcacagatacaaagact

SEQ ID NO: 20572 - DNA, 20 bp, Artificial Sequence
  Description of Artificial Sequence: Synthetic oligonucleotide
  Target: ATXN1; (+) strand; PAM type: NNGRRT; PAM sequence: ACGAAT
tgccttagagaacataggca

SEQ ID NO: 20573 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gtaaatcctcactaaatgat

SEQ ID NO: 20574 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gagggcagctagagagatgg

SEQ ID NO: 20575 - DNA, 20 bp, Artificial Sequence
  Description of Artificial Sequence: Synthetic oligonucleotide
  Target: ATXN1; (+) strand; PAM type: NNGRRT; PAM sequence: CAGGAT
agctatcttgtgaacagtcc

SEQ ID NO: 20576 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tctgtatcacttaagaggtt

SEQ ID NO: 20577 - DNA, 20 bp, Artificial Sequence
  Description of Artificial Sequence: Synthetic oligonucleotide
  Target: ATXN1; (+) strand; PAM type: NNGRRT; PAM sequence: TAGAGT
agcttagctattagacaata

SEQ ID NO: 20578 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gaagaggtgaagctggtgtt

SEQ ID NO: 20579 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atcatgttactctgcctaaa

SEQ ID NO: 20580 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tagtctaagttgccactaga

SEQ ID NO: 20581 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tggtaggaaaactgctctgg

SEQ ID NO: 20582 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gaaaccatgaggtgcccagc

SEQ ID NO: 20583 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gttcttccaacttaagttgc

SEQ ID NO: 20584 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tgttttaggcttttatctaa

SEQ ID NO: 20585 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ctaatagagtgtgagaagac

SEQ ID NO: 20586 - DNA, 20 bp, Artificial Sequence
  Description of Artificial Sequence: Synthetic oligonucleotide
  Target: ATXN1; (+) strand; PAM type: NNGRRT; PAM sequence: AAGGAT
acatgagttcacatgcagct

SEQ ID NO: 20587 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaggacacaggaaaaaaaa

SEQ ID NO: 20588 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tacatttgtcccctcctgcc

SEQ ID NO: 20589 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tttggtgctttcctgttcct

SEQ ID NO: 20590 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gggcatttttcaaaaccatt

SEQ ID NO: 20591 - DNA, 20 bp, Artificial Sequence
  Description of Artificial Sequence: Synthetic oligonucleotide
  Target: ATXN1; (+) strand; PAM type: NNGRRT; PAM sequence: TAGAGT
attttgaatgtaaaaggctg

SEQ ID NO: 20592 - DNA, 20 bp, Artificial Sequence
  Description of Artificial Sequence: Synthetic oligonucleotide
  Target: ATXN1; (+) strand; PAM type: NNGRRT; PAM sequence: AAGGGT
atgaggttatacacaggttc

SEQ ID NO: 20593 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ttatacacaggttcaagggt

SEQ ID NO: 20594 - DNA, 20 bp, Artificial Sequence
  Description of Artificial Sequence: Synthetic oligonucleotide
  Target: ATXN1; (+) strand; PAM type: NNGRRT; PAM sequence: CAGAGT
agggtaaagacaagcaggtg

SEQ ID NO: 20595 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aggtgcagagtttcacacgg

SEQ ID NO: 20596 - DNA, 20 bp, Artificial Sequence
  Description of Artificial Sequence: Synthetic oligonucleotide
  Target: ATXN1; (+) strand; PAM type: NNGRRT; PAM sequence: GTGAGT
cacgggagggtggggggggc

SEQ ID NO: 20597 - DNA, 20 bp, Artificial Sequence
  Description of Artificial Sequence: Synthetic oligonucleotide
  Target: ATXN1; (+) strand; PAM type: NNGRRT; PAM sequence: GTGAGT
atgcaaataggtgtgcagaa

SEQ ID NO: 20598 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gtgcacacaaatgcacatgt

SEQ ID NO: 20599 - DNA, 20 bp, Artificial Sequence
  Description of Artificial Sequence: Synthetic oligonucleotide
  Target: ATXN1; (+) strand; PAM type: NNGRRT; PAM sequence: GTGAGT
acacaaatgcacatgtgtgg

SEQ ID NO: 20600 - DNA, 20 bp, Artificial Sequence
  Description of Artificial Sequence: Synthetic oligonucleotide
  Target: ATXN1; (+) strand; PAM type: NNGRRT; PAM sequence: GTGAGT
atgcatacatgtgtgcaggc

SEQ ID NO: 20601 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gggcaatatggaaaaaaaca

SEQ ID NO: 20602 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cttcatcttttgaagtatat

SEQ ID NO: 20603 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttatttgcctctgtgctaag

SEQ ID NO: 20604 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ttgccagcagaaagatatag

SEQ ID NO: 20605 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ttctaagacctttgccttaa

SEQ ID NO: 20606 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aagacctttgccttaagtga

SEQ ID NO: 20607 - DNA, 20 bp, Artificial Sequence
  Description of Artificial Sequence: Synthetic oligonucleotide
  Target: ATXN1; (+) strand; PAM type: NNGRRT; PAM sequence: AAGGGT
acttggaaaagagaggcatg

SEQ ID NO: 20608 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gccctggcaattctgcctca

SEQ ID NO: 20609 - DNA, 20 bp, Artificial Sequence
  Description of Artificial Sequence: Synthetic oligonucleotide
  Target: ATXN1; (+) strand; PAM type: NNGRRT; PAM sequence: AAGAGT
agtattaattgttccttcct

SEQ ID NO: 20610 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aagcaaatcaacctgagaac

SEQ ID NO: 20611 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tttacaataaagattcagtg

SEQ ID NO: 20612 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tagggaaaacgctacaaaaa

SEQ ID NO: 20613 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tcacaagtcagagggaaacc

SEQ ID NO: 20614 - DNA, 20 bp, Artificial Sequence
  Description of Artificial Sequence: Synthetic oligonucleotide
  Target: ATXN1; (+) strand; PAM type: NNGRRT; PAM sequence: TAGAAT
cagtaaggtgctttaaaaaa

SEQ ID NO: 20615 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aaatttcagaaagggaactc

SEQ ID NO: 20616 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tttcataaagggacagtcag

SEQ ID NO: 20617 - DNA, 20 bp, Artificial Sequence
  Description of Artificial Sequence: Synthetic oligonucleotide
  Target: ATXN1; (+) strand; PAM type: NNGRRT; PAM sequence: AGGGGT
agtcagtggaatagagcacc

SEQ ID NO: 20618 - DNA, 20 bp, Artificial Sequence
  Description of Artificial Sequence: Synthetic oligonucleotide
  Target: ATXN1; (+) strand; PAM type: NNGRRT; PAM sequence: GGGAGT
aatagagcaccaggggtagg

SEQ ID NO: 20619 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttataatcacacacctctct

SEQ ID NO: 20620 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aaccaaccaagccccctgaa

SEQ ID NO: 20621 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ctgggtccttgtgatgttcc

SEQ ID NO: 20622 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gttccaggggtttaattaca

SEQ ID NO: 20623 - DNA, 20 bp, Artificial Sequence
  Description of Artificial Sequence: Synthetic oligonucleotide
  Target: ATXN1; (+) strand; PAM type: NNGRRT; PAM sequence: CGGGAT
aatggtttcctctactggtc

SEQ ID NO: 20624 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tcctctactggtccgggatt

SEQ ID NO: 20625 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ggggctctcttcacagatga

SEQ ID NO: 20626 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gtggaggcctagagagaggg

SEQ ID NO: 20627 - DNA, 20 bp, Artificial Sequence
  Description of Artificial Sequence: Synthetic oligonucleotide
  Target: ATXN1; (+) strand; PAM type: NNGRRT; PAM sequence: AAGGAT
agccttgattacaggctctc

SEQ ID NO: 20628 - DNA, 20 bp, Artificial Sequence
  Description of Artificial Sequence: Synthetic oligonucleotide
  Target: ATXN1; (+) strand; PAM type: NNGRRT; PAM sequence: GTGAGT
agaagacaaggtgaagcttt

SEQ ID NO: 20629 - DNA, 20 bp, Artificial Sequence
  Description of Artificial Sequence: Synthetic oligonucleotide
  Target: ATXN1; (+) strand; PAM type: NNGRRT; PAM sequence: AGGGGT
agtggacagaaattaaataa

SEQ ID NO: 20630 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ttatgcatcatttatcttca

SEQ ID NO: 20631 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gcttgaagcaaacgaaactt

SEQ ID NO: 20632 - DNA, 20 bp, Artificial Sequence
  Description of Artificial Sequence: Synthetic oligonucleotide
  Target: ATXN1; (+) strand; PAM type: NNGRRT; PAM sequence: GAGAAT
atggattggactagccttac

SEQ ID NO: 20633 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctgtgcctatagcagtttgt

SEQ ID NO: 20634 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ggcaggtggcagggagcggc

SEQ ID NO: 20635 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aacatcattgctcctacagg

SEQ ID NO: 20636 - DNA, 20 bp, Artificial Sequence
  Description of Artificial Sequence: Synthetic oligonucleotide
  Target: ATXN1; (+) strand; PAM type: NNGRRT; PAM sequence: ACGGGT
tacaggcagaatcaagagct

SEQ ID NO: 20637 - DNA, 20 bp, Artificial Sequence
  Description of Artificial Sequence: Synthetic oligonucleotide
  Target: ATXN1; (+) strand; PAM type: NNGRRT; PAM sequence: CCGGGT
agagggaagaaggacacaag

SEQ ID NO: 20638 - DNA, 20 bp, Artificial Sequence
  Description of Artificial Sequence: Synthetic oligonucleotide
  Target: ATXN1; (+) strand; PAM type: NNGRRT; PAM sequence: ATGAAT
agccgggtgtgtgcatgcgc

SEQ ID NO: 20639 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gtatctagttgatttacatc

SEQ ID NO: 20640 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gatttacatccagggttgcc

SEQ ID NO: 20641 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aacaaagtggccattttatg

SEQ ID NO: 20642 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ccattttatggggaatcaac

SEQ ID NO: 20643 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gctactcagaagacggtgga

SEQ ID NO: 20644 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actggcctggctttgaaaga

SEQ ID NO: 20645 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ctttgaaagagaggatcagc

SEQ ID NO: 20646 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gagaggatcagctgggatct

SEQ ID NO: 20647 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ctgggatctctgaatagatg

SEQ ID NO: 20648 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tctctgaatagatgaggagt

SEQ ID NO: 20649 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gtttcaggtgcaaaggaaat

SEQ ID NO: 20650 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gtgctccatgactctctgaa

SEQ ID NO: 20651 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ttccagaaccatctaatggc

SEQ ID NO: 20652 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttttgcactcagggccttcc

SEQ ID NO: 20653 - DNA, 20 bp, Artificial Sequence
  Description of Artificial Sequence: Synthetic oligonucleotide
  Target: ATXN1; (+) strand; PAM type: NNGRRT; PAM sequence: GAGAAT
taaaatgcctttcggtaaag

SEQ ID NO: 20654 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gcctttcggtaaaggagaat

SEQ ID NO: 20655 - DNA, 20 bp, Artificial Sequence
  Description of Artificial Sequence: Synthetic oligonucleotide
  Target: ATXN1; (+) strand; PAM type: NNGRRT; PAM sequence: GGGAAT
attttacgcattaactgtct

SEQ ID NO: 20656 - DNA, 20 bp, Artificial Sequence
  Description of Artificial Sequence: Synthetic oligonucleotide
  Target: ATXN1; (+) strand; PAM type: NNGRRT; PAM sequence: GCGGAT
attcacacaccttggagcct

SEQ ID NO: 20657 - DNA, 20 bp, Artificial Sequence
  Description of Artificial Sequence: Synthetic oligonucleotide
  Target: ATXN1; (+) strand; PAM type: NNGRRT; PAM sequence: CTGGGT
taaaacaattcagttgtaat

SEQ ID NO: 20658 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttactcactattcaaaattt

SEQ ID NO: 20659 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aagaagtcatctgggagaaa

SEQ ID NO: 20660 - DNA, 20 bp, Artificial Sequence
  Description of Artificial Sequence: Synthetic oligonucleotide
  Target: ATXN1; (+) strand; PAM type: NNGRRT; PAM sequence: CAGGGT
cacaaacacggctgcaatat

SEQ ID NO: 20661 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ccctataagcatgatgacat

SEQ ID NO: 20662 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ccacagaggcagagcttaga

SEQ ID NO: 20663 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ccgctatttcactctggaaa

SEQ ID NO: 20664 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ggcaatattgcttgaaattt

SEQ ID NO: 20665 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aggaggagagggctggtggg

SEQ ID NO: 20666 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ggaaggtgcagagaggacag

SEQ ID NO: 20667 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gtgaagccagccaggcaaat

SEQ ID NO: 20668 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gacagctcttctgcaagcag

SEQ ID NO: 20669 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gtgtgaaatggtcttagcca

SEQ ID NO: 20670 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gcctgtgtgtggtggtgggg

SEQ ID NO: 20671 - DNA, 20 bp, Artificial Sequence
  Description of Artificial Sequence: Synthetic oligonucleotide
  Target: ATXN1; (+) strand; PAM type: NNGRRT; PAM sequence: AAGGAT
agagagagagaggcagagag

SEQ ID NO: 20672 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aaaaaaagaccaagtagagg

SEQ ID NO: 20673 - DNA, 20 bp, Artificial Sequence
  Description of Artificial Sequence: Synthetic oligonucleotide
  Target: ATXN1; (+) strand; PAM type: NNGRRT; PAM sequence: GTGGAT
gaagagcaggaggcatcttt

SEQ ID NO: 20674 - DNA, 20 bp, Artificial Sequence
  Description of Artificial Sequence: Synthetic oligonucleotide
  Target: ATXN1; (+) strand; PAM type: NNGRRT; PAM sequence: TCGAAT
agacatcccttcccaagcat

SEQ ID NO: 20675 - DNA, 20 bp, Artificial Sequence
  Description of Artificial Sequence: Synthetic oligonucleotide
  Target: ATXN1; (+) strand; PAM type: NNGRRT; PAM sequence: CAGGGT
cttttaaggttaaggtaaac

SEQ ID NO: 20676 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ggcactgttgacatcttgtg

SEQ ID NO: 20677 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gggggctgtcctgtgtgttg

SEQ ID NO: 20678 - DNA, 20 bp, Artificial Sequence
  Description of Artificial Sequence: Synthetic oligonucleotide
  Target: ATXN1; (+) strand; PAM type: NNGRRT; PAM sequence: TAGAAT
cacggcggagggagcaaaat

SEQ ID NO: 20679 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tcacggaggtaaattttata

SEQ ID NO: 20680 - DNA, 20 bp, Artificial Sequence
  Description of Artificial Sequence: Synthetic oligonucleotide
  Target: ATXN1; (+) strand; PAM type: NNGRRT; PAM sequence: CAGAGT
caatgacaaaatccctaaga

SEQ ID NO: 20681 - DNA, 20 bp, Artificial Sequence
  Description of Artificial Sequence: Synthetic oligonucleotide
  Target: ATXN1; (+) strand; PAM type: NNGRRT; PAM sequence: AAGGGT
taaagtttgagcagaacatc

SEQ ID NO: 20682 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aggtgttgagctctagaagc

SEQ ID NO: 20683 - DNA, 20 bp, Artificial Sequence
  Description of Artificial Sequence: Synthetic oligonucleotide
  Target: ATXN1; (+) strand; PAM type: NNGRRT; PAM sequence: TAGGGT
aaatgtattccatagggctc

SEQ ID NO: 20684 - DNA, 20 bp, Artificial Sequence
  Description of Artificial Sequence: Synthetic oligonucleotide
  Target: ATXN1; (+) strand; PAM type: NNGRRT; PAM sequence: GGGGGT
agaggcatggggctgtggga

SEQ ID NO: 20685 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctgactttaatgttcatgga

SEQ ID NO: 20686 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tttgctcttgtcacccaggc

SEQ ID NO: 20687 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gattctcctgcctcagcctc

SEQ ID NO: 20688 - DNA, 20 bp, Artificial Sequence
  Description of Artificial Sequence: Synthetic oligonucleotide
  Target: ATXN1; (+) strand; PAM type: NNGRRT; PAM sequence: AGGGAT
gcctcagcctctggagtagt

SEQ ID NO: 20689 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttttgtgtttttagttgcga

SEQ ID NO: 20690 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aggactagtaatagcaaata

SEQ ID NO: 20691 - DNA, 20 bp, Artificial Sequence
  Description of Artificial Sequence: Synthetic oligonucleotide
  Target: ATXN1; (+) strand; PAM type: NNGRRT; PAM sequence: GAGAGT
aaatgaggaaaggagacagg

SEQ ID NO: 20692 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ccccaagtggggagaggtta

SEQ ID NO: 20693 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ttagaaggctttgcggaaga

SEQ ID NO: 20694 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gctgggccctgaagtagagg

SEQ ID NO: 20695 - DNA, 20 bp, Artificial Sequence
  Description of Artificial Sequence: Synthetic oligonucleotide
  Target: ATXN1; (+) strand; PAM type: NNGRRT; PAM sequence: CTGGGT
agaggaaggattttgacggg

SEQ ID NO: 20696 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gatgaacacgcacagaacat

SEQ ID NO: 20697 - DNA, 20 bp, Artificial Sequence
  Description of Artificial Sequence: Synthetic oligonucleotide
  Target: ATXN1; (+) strand; PAM type: NNGRRT; PAM sequence: GAGGGT
agtggagcagtgggggcggc

SEQ ID NO: 20698 - DNA, 20 bp, Artificial Sequence
  Description of Artificial Sequence: Synthetic oligonucleotide
  Target: ATXN1; (+) strand; PAM type: NNGRRT; PAM sequence: GGGGGT
agtgggggcggcgagggtag

SEQ ID NO: 20699 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atatatgcagaaatttgaca

SEQ ID NO: 20700 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aatttgacagtgggtgataa

SEQ ID NO: 20701 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gtgggtgataacaggatgtt

SEQ ID NO: 20702 - DNA, 20 bp, Artificial Sequence
  Description of Artificial Sequence: Synthetic oligonucleotide
  Target: ATXN1; (+) strand; PAM type: NNGRRT; PAM sequence: CAGAGT
acaaccagtagcaatagcat

SEQ ID NO: 20703 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ttttttttttttttttgaga

SEQ ID NO: 20704 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agaaagagtctcctccaggc

SEQ ID NO: 20705 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gccttagcctcccaagtagc

SEQ ID NO: 20706 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ttttgtatttttagtagaga

SEQ ID NO: 20707 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tgtgagccactgagcctggc

SEQ ID NO: 20708 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tagaagcattctgtgtttct

SEQ ID NO: 20709 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tggagctcaaacccaagtct

SEQ ID NO: 20710 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ggcaaaatcacaataagact

SEQ ID NO: 20711 - DNA, 20 bp, Artificial Sequence
  Description of Artificial Sequence: Synthetic oligonucleotide
  Target: ATXN1; (+) strand; PAM type: NNGRRT; PAM sequence: TGGAGT
cgtaagcgactaaatttgcc

SEQ ID NO: 20712 - DNA, 20 bp, Artificial Sequence
  Description of Artificial Sequence: Synthetic oligonucleotide
  Target: ATXN1; (+) strand; PAM type: NNGRRT; PAM sequence: GCGGGT
ggagtgacattatttttgtg

SEQ ID NO: 20713 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ttgtggcgggtgttgagact

SEQ ID NO: 20714 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gcgggtgttgagactgagaa

SEQ ID NO: 20715 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tggagggaaacggccacatc

SEQ ID NO: 20716 - DNA, 20 bp, Artificial Sequence
  Description of Artificial Sequence: Synthetic oligonucleotide
  Target: ATXN1; (+) strand; PAM type: NNGRRT; PAM sequence: GCGAGT
ctagtatactccaagatgtc

SEQ ID NO: 20717 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctccaagatgtcgcgagtcc

SEQ ID NO: 20718 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tttggtcttccagcaactat

SEQ ID NO: 20719 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aaggcaggaaagagggaagg

SEQ ID NO: 20720 - DNA, 20 bp, Artificial Sequence
  Description of Artificial Sequence: Synthetic oligonucleotide
  Target: ATXN1; (+) strand; PAM type: NNGRRT; PAM sequence: ATGAGT
acacaaagctgacagttatt

SEQ ID NO: 20721 - DNA, 20 bp, Artificial Sequence
  Description of Artificial Sequence: Synthetic oligonucleotide
  Target: ATXN1; (+) strand; PAM type: NNGRRT; PAM sequence: GAGAAT
actgactgtgtaagggagag

SEQ ID NO: 20722 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ataatgtctatggcgatgat

SEQ ID NO: 20723 - DNA, 20 bp, Artificial Sequence
  Description of Artificial Sequence: Synthetic oligonucleotide
  Target: ATXN1; (+) strand; PAM type: NNGRRT; PAM sequence: CTGAGT
atttcatctaactctcttga

SEQ ID NO: 20724 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tcttgactgagtcattccta

SEQ ID NO: 20725 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gagtcattcctatgggatta

SEQ ID NO: 20726 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ttatcaaaagcctctctaaa

SEQ ID NO: 20727 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aaaagcctctctaaaaaggg

SEQ ID NO: 20728 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aaaaaagaggcgggagaaat

SEQ ID NO: 20729 - DNA, 20 bp, Artificial Sequence
  Description of Artificial Sequence: Synthetic oligonucleotide
  Target: ATXN1; (+) strand; PAM type: NNGRRT; PAM sequence: CGGAAT
tgaccttcctcagcacagtc

SEQ ID NO: 20730 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ctccatgttttcttgggaag

SEQ ID NO: 20731 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aaggagggtctgtgcagatg

SEQ ID NO: 20732 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gtggggtttttttgggggaa

SEQ ID NO: 20733 - DNA, 20 bp, Artificial Sequence
  Description of Artificial Sequence: Synthetic oligonucleotide
  Target: ATXN1; (+) strand; PAM type: NNGRRT; PAM sequence: GGGGGT
tttttgggggaaatgggtgt

SEQ ID NO: 20734 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gtaggagcaggagcgtagat

SEQ ID NO: 20735 - DNA, 20 bp, Artificial Sequence
  Description of Artificial Sequence: Synthetic oligonucleotide
  Target: ATXN1; (+) strand; PAM type: NNGRRT; PAM sequence: TAGAAT
atccaagcataccaggtttt

SEQ ID NO: 20736 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tgagagaacattctgctggg

SEQ ID NO: 20737 - DNA, 20 bp, Artificial Sequence
  Description of Artificial Sequence: Synthetic oligonucleotide
  Target: ATXN1; (+) strand; PAM type: NNGRRT; PAM sequence: TCGAGT
cacccgttttatttttaaac

SEQ ID NO: 20738 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tcgagtgcagattttattcc

SEQ ID NO: 20739 - DNA, 20 bp, Artificial Sequence
  Description of Artificial Sequence: Synthetic oligonucleotide
  Target: ATXN1; (+) strand; PAM type: NNGRRT; PAM sequence: AGGGGT
aaattctccaagtacatttt

SEQ ID NO: 20740 - DNA, 20 bp, Artificial Sequence
  Description of Artificial Sequence: Synthetic oligonucleotide
  Target: ATXN1; (+) strand; PAM type: NNGRRT; PAM sequence: TCGAGT
tgattttgcagaagtaaaac

SEQ ID NO: 20741 - DNA, 20 bp, Artificial Sequence
  Description of Artificial Sequence: Synthetic oligonucleotide
  Target: ATXN1; (+) strand; PAM type: NNGRRT; PAM sequence: TTGGGT
caaaatagtgatgctatcta

SEQ ID NO: 20742 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gggtatttaactattttcca

SEQ ID NO: 20743 - DNA, 20 bp, Artificial Sequence
  Description of Artificial Sequence: Synthetic oligonucleotide
  Target: ATXN1; (+) strand; PAM type: NNGRRT; PAM sequence: CAGAGT
actaaggcagggagaactgc

SEQ ID NO: 20744 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ggcagggagaactgccagag

SEQ ID NO: 20745 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gctactatttatcattctaa

SEQ ID NO: 20746 - DNA, 20 bp, Artificial Sequence
  Description of Artificial Sequence: Synthetic oligonucleotide
  Target: ATXN1; (+) strand; PAM type: NNGRRT; PAM sequence: AGGAGT
aagaggaccagtctctgcgc

SEQ ID NO: 20747 - DNA, 20 bp, Artificial Sequence
  Description of Artificial Sequence: Synthetic oligonucleotide
  Target: ATXN1; (+) strand; PAM type: NNGRRT; PAM sequence: GAGGGT
agttttggtggtaaacatgt

SEQ ID NO: 20748 - DNA, 20 bp, Artificial Sequence
  Description of Artificial Sequence: Synthetic oligonucleotide
  Target: ATXN1; (+) strand; PAM type: NNGRRT; PAM sequence: GAGAGT
taaacatgtgagggtatcca

SEQ ID NO: 20749 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tccagagagtgatggaaatg

SEQ ID NO: 20750 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ttggcaacattaaatatgaa

SEQ ID NO: 20751 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aaggctgccaggctcatgct

SEQ ID NO: 20752 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aatatcatcatgaaatcaac

SEQ ID NO: 20753 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gaagggcttgaacccagcca

SEQ ID NO: 20754 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tcaatcctcacctctcagtt

SEQ ID NO: 20755 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tcctcacctctcagttcaga

SEQ ID NO: 20756 - DNA, 20 bp, Artificial Sequence
  Description of Artificial Sequence: Synthetic oligonucleotide
  Target: ATXN1; (+) strand; PAM type: NNGRRT; PAM sequence: ATGAAT
cgatctaccgcaacaataca

SEQ ID NO: 20757 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aacaatacaatgaataggtt

SEQ ID NO: 20758 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttgtgcatcagatctagaaa

SEQ ID NO: 20759 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgtcctatagccatgcttta

SEQ ID NO: 20760 - DNA, 20 bp, Artificial Sequence
  Description of Artificial Sequence: Synthetic oligonucleotide
  Target: ATXN1; (+) strand; PAM type: NNGRRT; PAM sequence: TAGAAT
atgctttatggaataaagca

SEQ ID NO: 20761 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ttttgcatttcatgtggcat

SEQ ID NO: 20762 - DNA, 20 bp, Artificial Sequence
  Description of Artificial Sequence: Synthetic oligonucleotide
  Target: ATXN1; (+) strand; PAM type: NNGRRT; PAM sequence: CTGAAT
taattggtgatccacacctt

SEQ ID NO: 20763 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ttatagttgttggctttaag

SEQ ID NO: 20764 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tttaaggaggataagaagaa

SEQ ID NO: 20765 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ctacaagcacattgtcttga

SEQ ID NO: 20766 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aaggccagaaatagtgaagc

SEQ ID NO: 20767 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cagagtgacagtctgcagac

SEQ ID NO: 20768 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gggtctcagcagctccgccc

SEQ ID NO: 20769 - DNA, 20 bp, Artificial Sequence
  Description of Artificial Sequence: Synthetic oligonucleotide
  Target: ATXN1; (+) strand; PAM type: NNGRRT; PAM sequence: ACGGAT
tgccggagctcaggcgagcc

SEQ ID NO: 20770 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tacctcctcacctgccaaac

SEQ ID NO: 20771 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cgacgcgtcctctaacctca

SEQ ID NO: 20772 - DNA, 20 bp, Artificial Sequence
  Description of Artificial Sequence: Synthetic oligonucleotide
  Target: ATXN1; (+) strand; PAM type: NNGRRT; PAM sequence: ATGGAT
acaacaagcactcagcaaac

SEQ ID NO: 20773 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ttaatttgacaccatatgct

SEQ ID NO: 20774 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aattggcatttataatattt

SEQ ID NO: 20775 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ctacctcagcctccgttggc

SEQ ID NO: 20776 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ggaggtgctatctttgtcct

SEQ ID NO: 20777 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tgctatctttgtcctcagaa

SEQ ID NO: 20778 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cccttctaaaactttgctta

SEQ ID NO: 20779 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgtacctcccttttaaaata

SEQ ID NO: 20780 - DNA, 20 bp, Artificial Sequence
  Description of Artificial Sequence: Synthetic oligonucleotide
  Target: ATXN1; (+) strand; PAM type: NNGRRT; PAM sequence: GAGAAT
caacaaatcaaatactgatg

SEQ ID NO: 20781 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gcactgtgctgctaggagct

SEQ ID NO: 20782 - DNA, 20 bp, Artificial Sequence
  Description of Artificial Sequence: Synthetic oligonucleotide
  Target: ATXN1; (+) strand; PAM type: NNGRRT; PAM sequence: CGGGGT
aatgttgtcaaagaaaagaa

SEQ ID NO: 20783 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aagaaggtaggttttaggac

SEQ ID NO: 20784 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tgatagtgggccggaagaga

SEQ ID NO: 20785 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aggacttttaggcatctgtc

SEQ ID NO: 20786 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tgatgccaatggctgagatg

SEQ ID NO: 20787 - DNA, 20 bp, Artificial Sequence
  Description of Artificial Sequence: Synthetic oligonucleotide
  Target: ATXN1; (+) strand; PAM type: NNGRRT; PAM sequence: TTGGGT
atggctgagatggggaattc

SEQ ID NO: 20788 - DNA, 20 bp, Artificial Sequence
  Description of Artificial Sequence: Synthetic oligonucleotide
  Target: ATXN1; (+) strand; PAM type: NNGRRT; PAM sequence: TGGGAT
cttgggtagatgaggtttgg

SEQ ID NO: 20789 - DNA, 20 bp, Artificial Sequence
  Description of Artificial Sequence: Synthetic oligonucleotide
  Target: ATXN1; (+) strand; PAM type: NNGRRT; PAM sequence: CTGAGT
taactttgactttgaacgtg

SEQ ID NO: 20790 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gtgataccccaaaggaggtg

SEQ ID NO: 20791 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gagaggtctggcctagaaac

SEQ ID NO: 20792 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tggcctagaaacatggatgc

SEQ ID NO: 20793 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gaaacatggatgcaggagtc

SEQ ID NO: 20794 - DNA, 20 bp, Artificial Sequence
  Description of Artificial Sequence: Synthetic oligonucleotide
  Target: ATXN1; (+) strand; PAM type: NNGRRT; PAM sequence: GTGAGT
catggatccatcaaggcact

SEQ ID NO: 20795 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tccatcaaggcactgtgagt

SEQ ID NO: 20796 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ttaggaaggaggggccagaa

SEQ ID NO: 20797 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tttagacaggagggggagag

SEQ ID NO: 20798 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acacaactggtccaatgaca

SEQ ID NO: 20799 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ctgatgaccaagcaggagac

SEQ ID NO: 20800 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gagcaagctgaagccagcta

SEQ ID NO: 20801 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aattttctcacctgtaaaac

SEQ ID NO: 20802 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttttcttttttttttggaga

SEQ ID NO: 20803 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcacccaggc

SEQ ID NO: 20804 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ctcactgcaatctccacctc

SEQ ID NO: 20805 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tattctcctgccttagcctc

SEQ ID NO: 20806 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtagaga

SEQ ID NO: 20807 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcttcagcctcccaaagtgc

SEQ ID NO: 20808 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tggctgactcatagtagttg

SEQ ID NO: 20809 - DNA, 20 bp, Artificial Sequence
  Description of Artificial Sequence: Synthetic oligonucleotide
  Target: ATXN1; (+) strand; PAM type: NNGRRT; PAM sequence: TAGGGT
agttaagcagaaaagggggc

SEQ ID NO: 20810 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aacagaaggtaccaaggtcc

SEQ ID NO: 20811 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tcgaggtggtgttcctggca

SEQ ID NO: 20812 - DNA, 20 bp, Artificial Sequence
  Description of Artificial Sequence: Synthetic oligonucleotide
  Target: ATXN1; (+) strand; PAM type: NNGRRT; PAM sequence: GGGGGT
tgttcctggcactgagtaaa

SEQ ID NO: 20813 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gggagcaggaaatgaagtca

SEQ ID NO: 20814 - DNA, 20 bp, Artificial Sequence
  Description of Artificial Sequence: Synthetic oligonucleotide
  Target: ATXN1; (+) strand; PAM type: NNGRRT; PAM sequence: GGGGGT
aggaaatgaagtcagagggt

SEQ ID NO: 20815 - DNA, 20 bp, Artificial Sequence
  Description of Artificial Sequence: Synthetic oligonucleotide
  Target: ATXN1; (+) strand; PAM type: NNGRRT; PAM sequence: CTGAGT
taaagtctgaggtccttact

SEQ ID NO: 20816 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gagtgagctgagaggcactg

SEQ ID NO: 20817 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ggttttgatcagaggaggta

SEQ ID NO: 20818 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atggtggcaccgtggaccag

SEQ ID NO: 20819 - DNA, 20 bp, Artificial Sequence
  Description of Artificial Sequence: Synthetic oligonucleotide
  Target: ATXN1; (+) strand; PAM type: NNGRRT; PAM sequence: CTGAGT
acaacgtcaacaactgtggc

SEQ ID NO: 20820 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aggcagtgggagaagcaggt

SEQ ID NO: 20821 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gtgggagaagcaggttgggg

SEQ ID NO: 20822 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gcaggttggggtagaatatc

SEQ ID NO: 20823 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tgaaggcagttaagagacag

SEQ ID NO: 20824 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gtgattaggctgtatcggct

SEQ ID NO: 20825 - DNA, 20 bp, Artificial Sequence
  Description of Artificial Sequence: Synthetic oligonucleotide
  Target: ATXN1; (+) strand; PAM type: NNGRRT; PAM sequence: GGGAGT
aggctgtatcggctgtgggt

SEQ ID NO: 20826 - DNA, 20 bp, Artificial Sequence
  Description of Artificial Sequence: Synthetic oligonucleotide
  Target: ATXN1; (+) strand; PAM type: NNGRRT; PAM sequence: GCGGAT
cccgtggaaggctacttgat

SEQ ID NO: 20827 - DNA, 20 bp, Artificial Sequence
  Description of Artificial Sequence: Synthetic oligonucleotide
  Target: ATXN1; (+) strand; PAM type: NNGRRT; PAM sequence: GGGAAT
agcagaggccagaggtggct

SEQ ID NO: 20828 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tacagaactgataagactcc

SEQ ID NO: 20829 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ccttttgttccagcccattt

SEQ ID NO: 20830 - DNA, 20 bp, Artificial Sequence
  Description of Artificial Sequence: Synthetic oligonucleotide
  Target: ATXN1; (+) strand; PAM type: NNGRRT; PAM sequence: GAGAGT
accatggaagctaggtagca

SEQ ID NO: 20831 - DNA, 20 bp, Artificial Sequence
  Description of Artificial Sequence: Synthetic oligonucleotide
  Target: ATXN1; (+) strand; PAM type: NNGRRT; PAM sequence: GAGGGT
catggaccttgtctggggaa

SEQ ID NO: 20832 - DNA, 20 bp, Artificial Sequence
  Description of Artificial Sequence: Synthetic oligonucleotide
  Target: ATXN1; (+) strand; PAM type: NNGRRT; PAM sequence: ATGGGT
taattctggccttggctact

SEQ ID NO: 20833 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tggcactggtccatgaggct

SEQ ID NO: 20834 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gtccatgaggctaggggtag

SEQ ID NO: 20835 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cggttcactttcctatgaga

SEQ ID NO: 20836 - DNA, 20 bp, Artificial Sequence
  Description of Artificial Sequence: Synthetic oligonucleotide
  Target: ATXN1; (+) strand; PAM type: NNGRRT; PAM sequence: AGGGGT
cccataatggtccatggccc

SEQ ID NO: 20837 - DNA, 20 bp, Artificial Sequence
  Description of Artificial Sequence: Synthetic oligonucleotide
  Target: ATXN1; (+) strand; PAM type: NNGRRT; PAM sequence: TTGAGT
taatacatttagtgccagct

SEQ ID NO: 20838 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttatattgtatattttatcc

SEQ ID NO: 20839 - DNA, 20 bp, Artificial Sequence
  Description of Artificial Sequence: Synthetic oligonucleotide
  Target: ATXN1; (+) strand; PAM type: NNGRRT; PAM sequence: GAGGAT
atacctataaatccagccag

SEQ ID NO: 20840 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aaatccagccaggaggatct

SEQ ID NO: 20841 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tcaagaaactcttaaaataa

SEQ ID NO: 20842 - DNA, 20 bp, Artificial Sequence
  Description of Artificial Sequence: Synthetic oligonucleotide
  Target: ATXN1; (+) strand; PAM type: NNGRRT; PAM sequence: AGGAGT
actcgatcaatgccaaatga

SEQ ID NO: 20843 - DNA, 20 bp, Artificial Sequence
  Description of Artificial Sequence: Synthetic oligonucleotide
  Target: ATXN1; (+) strand; PAM type: NNGRRT; PAM sequence: TGGAAT
agcaattcaagttgctattc

SEQ ID NO: 20844 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tggaatctcttgtgtaagat

SEQ ID NO: 20845 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aagatgggaatcaagtctaa

SEQ ID NO: 20846 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aagtctaacagagtcattaa

SEQ ID NO: 20847 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ccaaagttaccctttcatta

SEQ ID NO: 20848 - DNA, 20 bp, Artificial Sequence
  Description of Artificial Sequence: Synthetic oligonucleotide
  Target: ATXN1; (+) strand; PAM type: NNGRRT; PAM sequence: GTGGAT
ctgaatttctcagattctca

SEQ ID NO: 20849 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ccatgttatgaagggcctcc

SEQ ID NO: 20850 - DNA, 20 bp, Artificial Sequence
  Description of Artificial Sequence: Synthetic oligonucleotide
  Target: ATXN1; (+) strand; PAM type: NNGRRT; PAM sequence: GAGAGT
aggacaaaatagaaaaagca

SEQ ID NO: 20851 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ggcggggccgggggcggggc

SEQ ID NO: 20852 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gccgggggcggggcgggaat

SEQ ID NO: 20853 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ggcggggcgggaataagggt

SEQ ID NO: 20854 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ggcgggaataagggttgggg

SEQ ID NO: 20855 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aataagggttggggtggggt

SEQ ID NO: 20856 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tggggtggggatgctgacat

SEQ ID NO: 20857 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gctgacatcagaatgtgtac

SEQ ID NO: 20858 - DNA, 20 bp, Artificial Sequence
  Description of Artificial Sequence: Synthetic oligonucleotide
  Target: ATXN1; (+) strand; PAM type: NNGRRT; PAM sequence: AGGGGT
aatgtgtaccagagtgactc

SEQ ID NO: 20859 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gatctaaattgtgtcttttg

SEQ ID NO: 20860 - DNA, 20 bp, Artificial Sequence
  Description of Artificial Sequence: Synthetic oligonucleotide
  Target: ATXN1; (+) strand; PAM type: NNGRRT; PAM sequence: GTGGGT
accaaaaatacaaaaattag

SEQ ID NO: 20861 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgggaggctgaggcag

SEQ ID NO: 20862 - DNA, 20 bp, Artificial Sequence
  Description of Artificial Sequence: Synthetic oligonucleotide
  Target: ATXN1; (+) strand; PAM type: NNGRRT; PAM sequence: ATGGGT
cagcactttgggaggtctaa

SEQ ID NO: 20863 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggtctaaatgg

SEQ ID NO: 20864 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggtggatcgcttgaaccc

SEQ ID NO: 20865 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tgattggagaaaacaaatag

SEQ ID NO: 20866 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agaggcaaaagaacgtggga

SEQ ID NO: 20867 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaataagaaggaacacaaga

SEQ ID NO: 20868 - DNA, 20 bp, Artificial Sequence
  Description of Artificial Sequence: Synthetic oligonucleotide
  Target: ATXN1; (+) strand; PAM type: NNGRRT; PAM sequence: TGGGAT
agctacttgggaggctaagg

SEQ ID NO: 20869 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactccaacctgggaaa

SEQ ID NO: 20870 - DNA, 20 bp, Artificial Sequence
  Description of Artificial Sequence: Synthetic oligonucleotide
  Target: ATXN1; (+) strand; PAM type: NNGRRT; PAM sequence: GGGAAT
agaaaagaaaaaattaaagc

SEQ ID NO: 20871 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cacagtttaaaaaaattttt

SEQ ID NO: 20872 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aacaacaaaaacagagaaat

SEQ ID NO: 20873 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tagtccataaacctgaagac

SEQ ID NO: 20874 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ccataaacctgaagacagga

SEQ ID NO: 20875 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ggtccttacggcacggtcag

SEQ ID NO: 20876 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gcacagcagcatcattggca

SEQ ID NO: 20877 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atcattggcaaggggtcctg

SEQ ID NO: 20878 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gtcctgcagaatccaattca

SEQ ID NO: 20879 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tgagaagaaacttttgagag

SEQ ID NO: 20880 - DNA, 20 bp, Artificial Sequence
  Description of Artificial Sequence: Synthetic oligonucleotide
  Target: ATXN1; (+) strand; PAM type: NNGRRT; PAM sequence: CGGAGT
tccatggaaacaacagaaga

SEQ ID NO: 20881 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aaaactcattccacttaaaa

SEQ ID NO: 20882 - DNA, 20 bp, Artificial Sequence
  Description of Artificial Sequence: Synthetic oligonucleotide
  Target: ATXN1; (+) strand; PAM type: NNGRRT; PAM sequence: TAGGAT
cttaaaaatgagtaacaaaa

SEQ ID NO: 20883 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gttattataagaagaaaaat

SEQ ID NO: 20884 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tgattggagaaaagaaatag

SEQ ID NO: 20885 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agaggcaaaagaacgtggga

SEQ ID NO: 20886 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaataagaaggaacacaaga

SEQ ID NO: 20887 - DNA, 20 bp, Artificial Sequence
  Description of Artificial Sequence: Synthetic oligonucleotide
  Target: ATXN1; (+) strand; PAM type: NNGRRT; PAM sequence: AGGAGT
catacaacagataatctttg

SEQ ID NO: 20888 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aaaagaaatgaggaaagaaa

SEQ ID NO: 20889 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gatttgaaactatatattga

SEQ ID NO: 20890 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tggacactcaggtaaaatga

SEQ ID NO: 20891 - DNA, 20 bp, Artificial Sequence
  Description of Artificial Sequence: Synthetic oligonucleotide
  Target: ATXN1; (+) strand; PAM type: NNGRRT; PAM sequence: TAGAGT
acctataagggacagaaaat

SEQ ID NO: 20892 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tcaggaaagacaactaagcc

SEQ ID NO: 20893 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ccagccaacaacaatctgtt

SEQ ID NO: 20894 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tatgaatatgcaaggaccca

SEQ ID NO: 20895 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cttagtaatctgcaagggag

SEQ ID NO: 20896 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gaaaggcactgatacaaaga

SEQ ID NO: 20897 - DNA, 20 bp, Artificial Sequence
  Description of Artificial Sequence: Synthetic oligonucleotide
  Target: ATXN1; (+) strand; PAM type: NNGRRT; PAM sequence: AAGAAT
attaaaaaaaaacacgcggg

SEQ ID NO: 20898 - DNA, 20 bp, Artificial Sequence
  Description of Artificial Sequence: Synthetic oligonucleotide
  Target: ATXN1; (+) strand; PAM type: NNGRRT; PAM sequence: GGGAGT
cactaacatagatgttaagt

SEQ ID NO: 20899 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tagatgttaagtgggagtaa

SEQ ID NO: 20900 - DNA, 20 bp, Artificial Sequence
  Description of Artificial Sequence: Synthetic oligonucleotide
  Target: ATXN1; (+) strand; PAM type: NNGRRT; PAM sequence: AAGGGT
agagaagaaaataagaaaga

SEQ ID NO: 20901 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aataagaaagaaagggtact

SEQ ID NO: 20902 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctaagaatttcaaaatcact

SEQ ID NO: 20903 - DNA, 20 bp, Artificial Sequence
  Description of Artificial Sequence: Synthetic oligonucleotide
  Target: ATXN1; (+) strand; PAM type: NNGRRT; PAM sequence: GGGGAT
caacagctaagaaaagtttg

SEQ ID NO: 20904 - DNA, 20 bp, Artificial Sequence
  Description of Artificial Sequence: Synthetic oligonucleotide
  Target: ATXN1; (+) strand; PAM type: NNGRRT; PAM sequence: AAGGGT
agaaaagtttgggggataag

SEQ ID NO: 20905 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ataagaagggtaccatatta

SEQ ID NO: 20906 - DNA, 20 bp, Artificial Sequence
  Description of Artificial Sequence: Synthetic oligonucleotide
  Target: ATXN1; (+) strand; PAM type: NNGRRT; PAM sequence: GCGGGT
caacactttgggaggccaag

SEQ ID NO: 20907 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccaaggcgg

SEQ ID NO: 20908 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcac

SEQ ID NO: 20909 - DNA, 20 bp, Artificial Sequence
  Description of Artificial Sequence: Synthetic oligonucleotide
  Target: ATXN1; (+) strand; PAM type: NNGRRT; PAM sequence: GAGGGT
cgagaattgcttaaacccag

SEQ ID NO: 20910 - DNA, 20 bp, Artificial Sequence
  Description of Artificial Sequence: Synthetic oligonucleotide
  Target: ATXN1; (+) strand; PAM type: NNGRRT; PAM sequence: CCGGGT
tggtgccactgctctccagc

SEQ ID NO: 20911 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tacttggggggctgaggcag

SEQ ID NO: 20912 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cagaaggattgcttaagcct

SEQ ID NO: 20913 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctgtaccactgtactccagc

SEQ ID NO: 20914 - DNA, 20 bp, Artificial Sequence
  Description of Artificial Sequence: Synthetic oligonucleotide
  Target: ATXN1; (+) strand; PAM type: NNGRRT; PAM sequence: GTGGGT
caacgacttcaccttgtttt

SEQ ID NO: 20915 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tttttatataattattgaac

SEQ ID NO: 20916 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tgtagtgtgggagaaagtaa

SEQ ID NO: 20917 - DNA, 20 bp, Artificial Sequence
  Description of Artificial Sequence: Synthetic oligonucleotide
  Target: ATXN1; (+) strand; PAM type: NNGRRT; PAM sequence: GTGAGT
aatgagtaaattgtgttggt

SEQ ID NO: 20918 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaagaaaatactgatgtaaa

SEQ ID NO: 20919 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgggaggctgaggcag

SEQ ID NO: 20920 - DNA, 20 bp, Artificial Sequence
  Description of Artificial Sequence: Synthetic oligonucleotide
  Target: ATXN1; (+) strand; PAM type: NNGRRT; PAM sequence: TTGGAT
actatcaaagacagccagta

SEQ ID NO: 20921 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aaaaggactcagtagccaaa

SEQ ID NO: 20922 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gactcagtagccaaactgaa

SEQ ID NO: 20923 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gggaccatctgaacatgaaa

SEQ ID NO: 20924 - DNA, 20 bp, Artificial Sequence
  Description of Artificial Sequence: Synthetic oligonucleotide
  Target: ATXN1; (+) strand; PAM type: NNGRRT; PAM sequence: ATGAAT
caacagatatgctgcaatct

SEQ ID NO: 20925 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cgtgcaaattggtaaataga

SEQ ID NO: 20926 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ttcctacaaaacctgaagca

SEQ ID NO: 20927 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gtagataaattacagatgca

SEQ ID NO: 20928 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aacaaatgaacaaataataa

SEQ ID NO: 20929 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttgcaatccctgataaattt

SEQ ID NO: 20930 - DNA, 20 bp, Artificial Sequence
  Description of Artificial Sequence: Synthetic oligonucleotide
  Target: ATXN1; (+) strand; PAM type: NNGRRT; PAM sequence: ACGGGT
aggcaatcatccaaacccag

SEQ ID NO: 20931 - DNA, 20 bp, Artificial Sequence
  Description of Artificial Sequence: Synthetic oligonucleotide
  Target: ATXN1; (+) strand; PAM type: NNGRRT; PAM sequence: CCGAGT
aaaaaaagacataggtgata

SEQ ID NO: 20932 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gagaccgaaatgacctttat

SEQ ID NO: 20933 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aataagtcaattaggaaaat

SEQ ID NO: 20934 - DNA, 20 bp, Artificial Sequence
  Description of Artificial Sequence: Synthetic oligonucleotide
  Target: ATXN1; (+) strand; PAM type: NNGRRT; PAM sequence: CGGGAT
taggaaaatatgaatactga

SEQ ID NO: 20935 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttgtagttgtgtatgagaag

SEQ ID NO: 20936 - DNA, 20 bp, Artificial Sequence
  Description of Artificial Sequence: Synthetic oligonucleotide
  Target: ATXN1; (+) strand; PAM type: NNGRRT; PAM sequence: TTGAGT
taaaatattttatagatatt

SEQ ID NO: 20937 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ttatgaagatgcaaggtcca

SEQ ID NO: 20938 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gtccagggaatactgttatt

SEQ ID NO: 20939 - DNA, 20 bp, Artificial Sequence
  Description of Artificial Sequence: Synthetic oligonucleotide
  Target: ATXN1; (+) strand; PAM type: NNGRRT; PAM sequence: TGGAGT
aaataatccaggtgcagagg

SEQ ID NO: 20940 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aaacgatgttggctctgctg

SEQ ID NO: 20941 - DNA, 20 bp, Artificial Sequence
  Description of Artificial Sequence: Synthetic oligonucleotide
  Target: ATXN1; (+) strand; PAM type: NNGRRT; PAM sequence: TGGGGT
atgttggctctgctgctgaa

SEQ ID NO: 20942 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tattattatactttaagttt

SEQ ID NO: 20943 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ccccaccccacaacagtccc

SEQ ID NO: 20944 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tcattgttcaattcccatct

SEQ ID NO: 20945 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgtccttgtgatagtttact

SEQ ID NO: 20946 - DNA, 20 bp, Artificial Sequence
  Description of Artificial Sequence: Synthetic oligonucleotide
  Target: ATXN1; (+) strand; PAM type: NNGRRT; PAM sequence: TTGGGT
agtctatcattgttggacat

SEQ ID NO: 20947 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ggttccaagtctttgctatt

SEQ ID NO: 20948 - DNA, 20 bp, Artificial Sequence
  Description of Artificial Sequence: Synthetic oligonucleotide
  Target: ATXN1; (+) strand; PAM type: NNGRRT; PAM sequence: TTGGGT
gcagcatgatttatagtcct

SEQ ID NO: 20949 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tttgggtatatacccagtaa

SEQ ID NO: 20950 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tatacccagtaatgggatgg

SEQ ID NO: 20951 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tttctagttctagatccctg

SEQ ID NO: 20952 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ggtttcccacagccttcctt

SEQ ID NO: 20953 - DNA, 20 bp, Artificial Sequence
  Description of Artificial Sequence: Synthetic oligonucleotide
  Target: ATXN1; (+) strand; PAM type: NNGRRT; PAM sequence: GTGAAT
agctgcccaaccccagattt

SEQ ID NO: 20954 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ccaaccccagatttgtgaat

SEQ ID NO: 20955 - DNA, 20 bp, Artificial Sequence
  Description of Artificial Sequence: Synthetic oligonucleotide
  Target: ATXN1; (+) strand; PAM type: NNGRRT; PAM sequence: GGGAGT
atttgtgaatcagaattcct

SEQ ID NO: 20956 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aataaattatttctttttca

SEQ ID NO: 20957 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aaatttttattatgggagaa

SEQ ID NO: 20958 - DNA, 20 bp, Artificial Sequence
  Description of Artificial Sequence: Synthetic oligonucleotide
  Target: ATXN1; (+) strand; PAM type: NNGRRT; PAM sequence: TAGAGT
ataaactagaggaaatagcc

SEQ ID NO: 20959 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aggaaatagcctagagtaac

SEQ ID NO: 20960 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cacaagcactattttccaaa

SEQ ID NO: 20961 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cactagaagccagaggcttg

SEQ ID NO: 20962 - DNA, 20 bp, Artificial Sequence
  Description of Artificial Sequence: Synthetic oligonucleotide
  Target: ATXN1; (+) strand; PAM type: NNGRRT; PAM sequence: CGGGAT
ggaaagtaaatatagtgtac

SEQ ID NO: 20963 - DNA, 20 bp, Artificial Sequence
  Description of Artificial Sequence: Synthetic oligonucleotide
  Target: ATXN1; (+) strand; PAM type: NNGRRT; PAM sequence: CAGGGT
attaattaatttttttgaga

SEQ ID NO: 20964 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tctcgttctgtcacccacgt

SEQ ID NO: 20965 - DNA, 20 bp, Artificial Sequence
  Description of Artificial Sequence: Synthetic oligonucleotide
  Target: ATXN1; (+) strand; PAM type: NNGRRT; PAM sequence: TTGGGT
catactgcaaccttggcctc

SEQ ID NO: 20966 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tattctcctgcctcagcctc

SEQ ID NO: 20967 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ctaatttttgtatttttagt

SEQ ID NO: 20968 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtaggga

SEQ ID NO: 20969 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gcctcagcctcccaaagtgc

SEQ ID NO: 20970 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atttttattttttatcaagg

SEQ ID NO: 20971 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcggcctcccaaagtgc

SEQ ID NO: 20972 - DNA, 20 bp, Artificial Sequence
  Description of Artificial Sequence: Synthetic oligonucleotide
  Target: ATXN1; (+) strand; PAM type: NNGRRT; PAM sequence: TAGGAT
acactcttagaagctttata

SEQ ID NO: 20973 - DNA, 20 bp, Artificial Sequence
  Description of Artificial Sequence: Synthetic oligonucleotide
  Target: ATXN1; (+) strand; PAM type: NNGRRT; PAM sequence: TTGAAT
atctgcgttttatttttaaa

SEQ ID NO: 20974 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gctctccatgtgccatatag

SEQ ID NO: 20975 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ataacacttaattcaggggc

SEQ ID NO: 20976 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tctaaagttcccacccaatg

SEQ ID NO: 20977 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tcccacccaatgcagagtgt

SEQ ID NO: 20978 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ggcacaatcctggtcctacc

SEQ ID NO: 20979 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ctagaatgctcctctggcaa

SEQ ID NO: 20980 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tgttggtttgtttcctgcgc

SEQ ID NO: 20981 - DNA, 20 bp, Artificial Sequence
  Description of Artificial Sequence: Synthetic oligonucleotide
  Target: ATXN1; (+) strand; PAM type: NNGRRT; PAM sequence: GGGGGT
atcacaggtgtacatatttt

SEQ ID NO: 20982 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ggtacaagtgatatgtacta

SEQ ID NO: 20983 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ttgctcaaactgcagcacct

SEQ ID NO: 20984 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gcaacaatgctcacatacag

SEQ ID NO: 20985 - DNA, 20 bp, Artificial Sequence
  Description of Artificial Sequence: Synthetic oligonucleotide
  Target: ATXN1; (+) strand; PAM type: NNGRRT; PAM sequence: AAGGGT
caagcttttttgcttgcatg

SEQ ID NO: 20986 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ttatttgttgctgttgttgt

SEQ ID NO: 20987 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ctgttgttgtgagggttaaa

SEQ ID NO: 20988 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgagggttaaaggggatagc

SEQ ID NO: 20989 - DNA, 20 bp, Artificial Sequence
  Description of Artificial Sequence: Synthetic oligonucleotide
  Target: ATXN1; (+) strand; PAM type: NNGRRT; PAM sequence: ATGAGT
agtgagcaccctagtacagc

SEQ ID NO: 20990 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ccaagaccagacaaaacacc

SEQ ID NO: 20991 - DNA, 20 bp, Artificial Sequence
  Description of Artificial Sequence: Synthetic oligonucleotide
  Target: ATXN1; (+) strand; PAM type: NNGRRT; PAM sequence: GTGAAT
accctgagttcttgtcctca

SEQ ID NO: 20992 - DNA, 20 bp, Artificial Sequence
  Description of Artificial Sequence: Synthetic oligonucleotide
  Target: ATXN1; (+) strand; PAM type: NNGRRT; PAM sequence: ATGAGT
atgagccctccctcaggctt

SEQ ID NO: 20993 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tttaagtgaacacgttttaa

SEQ ID NO: 20994 - DNA, 20 bp, Artificial Sequence
  Description of Artificial Sequence: Synthetic oligonucleotide
  Target: ATXN1; (+) strand; PAM type: NNGRRT; PAM sequence: GGGAAT
atttgcaactccttatttta

SEQ ID NO: 20995 - DNA, 20 bp, Artificial Sequence
  Description of Artificial Sequence: Synthetic oligonucleotide
  Target: ATXN1; (+) strand; PAM type: NNGRRT; PAM sequence: CAGGGT
aactccttattttagggaat

SEQ ID NO: 20996 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taaacctccaagtaaaggca

SEQ ID NO: 20997 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agtaaaggcaatgaatgata

SEQ ID NO: 20998 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atgatacagaatttgtacct

SEQ ID NO: 20999 - DNA, 20 bp, Artificial Sequence
  Description of Artificial Sequence: Synthetic oligonucleotide
  Target: ATXN1; (+) strand; PAM type: NNGRRT; PAM sequence: ATGAAT
cactcagatataagtaatat

SEQ ID NO: 21000 - DNA, 20 bp, Artificial Sequence
  Description of Artificial Sequence: Synthetic oligonucleotide
  Target: ATXN1; (+) strand; PAM type: NNGRRT; PAM sequence: GAGAAT
acacacatgcatggttctta

SEQ ID NO: 21001 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agagaatggaaggacaggag

SEQ ID NO: 21002 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtgctctctgattcaaggga

SEQ ID NO: 21003 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gccagcacgtttattattag

SEQ ID NO: 21004 - DNA, 20 bp, Artificial Sequence
  Description of Artificial Sequence: Synthetic oligonucleotide
  Target: ATXN1; (+) strand; PAM type: NNGRRT; PAM sequence: ATGAGT
atctgcaacatggagatgct

SEQ ID NO: 21005 - DNA, 20 bp, Artificial Sequence
  Description of Artificial Sequence: Synthetic oligonucleotide
  Target: ATXN1; (+) strand; PAM type: NNGRRT; PAM sequence: ATGAAT
acctccatatgaagtattca

SEQ ID NO: 21006 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gggaaaggaccttctaggtg

SEQ ID NO: 21007 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tgtgaacgcacctgatccat

SEQ ID NO: 21008 - DNA, 20 bp, Artificial Sequence
  Description of Artificial Sequence: Synthetic oligonucleotide
  Target: ATXN1; (+) strand; PAM type: NNGRRT; PAM sequence: GGGGGT
aaaaggacaacaggggcggc

SEQ ID NO: 21009 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gagccacatggccattcctt

SEQ ID NO: 21010 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttccttgagaattactaatc

SEQ ID NO: 21011 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tcatgaatcattcggttctc

SEQ ID NO: 21012 - DNA, 20 bp, Artificial Sequence
  Description of Artificial Sequence: Synthetic oligonucleotide
  Target: ATXN1; (+) strand; PAM type: NNGRRT; PAM sequence: TAGGAT
cttcagctgtacaaattata

SEQ ID NO: 21013 - DNA, 20 bp, Artificial Sequence
  Description of Artificial Sequence: Synthetic oligonucleotide
  Target: ATXN1; (+) strand; PAM type: NNGRRT; PAM sequence: TGGGAT
cgcctgtaatcccagaactt

SEQ ID NO: 21014 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cagaactttgggatgcccag

SEQ ID NO: 21015 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggatgcccaggtgg

SEQ ID NO: 21016 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tgggtggatcaccaaaggtc

SEQ ID NO: 21017 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tactcaggaggctgaggcag

SEQ ID NO: 21018 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aatcacttgaacccgagggc

SEQ ID NO: 21019 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ccggcagatcacctgaggtc

SEQ ID NO: 21020 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tagtatagttgaaagaaacg

SEQ ID NO: 21021 - DNA, 20 bp, Artificial Sequence
  Description of Artificial Sequence: Synthetic oligonucleotide
  Target: ATXN1; (+) strand; PAM type: NNGRRT; PAM sequence: TAGAGT
agaaacgtggagtttgtaat

SEQ ID NO: 21022 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tctgcatatagaaaatattc

SEQ ID NO: 21023 - DNA, 20 bp, Artificial Sequence
  Description of Artificial Sequence: Synthetic oligonucleotide
  Target: ATXN1; (+) strand; PAM type: NNGRRT; PAM sequence: CCGAAT
agggaagtccccttaggcgt

SEQ ID NO: 21024 - DNA, 20 bp, Artificial Sequence
  Description of Artificial Sequence: Synthetic oligonucleotide
  Target: ATXN1; (+) strand; PAM type: NNGRRT; PAM sequence: TAGAAT
cagatgcctactatagcaag

SEQ ID NO: 21025 - DNA, 20 bp, Artificial Sequence
  Description of Artificial Sequence: Synthetic oligonucleotide
  Target: ATXN1; (+) strand; PAM type: NNGRRT; PAM sequence: GAGGGT
caccagactgtgagcttttt

SEQ ID NO: 21026 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gggtaaagattatgttttct

SEQ ID NO: 21027 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gattatgttttctccgagtt

SEQ ID NO: 21028 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tggcattcaataaatattta

SEQ ID NO: 21029 - DNA, 20 bp, Artificial Sequence
  Description of Artificial Sequence: Synthetic oligonucleotide
  Target: ATXN1; (+) strand; PAM type: NNGRRT; PAM sequence: ATGAAT
attcaataaatatttaggga

SEQ ID NO: 21030 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tttagggaatgaatacatgc

SEQ ID NO: 21031 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gggaatgaatacatgcaggg

SEQ ID NO: 21032 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aacaggttacaaatacggtt

SEQ ID NO: 21033 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttcagaattcataactagta

SEQ ID NO: 21034 - DNA, 20 bp, Artificial Sequence
  Description of Artificial Sequence: Synthetic oligonucleotide
  Target: ATXN1; (+) strand; PAM type: NNGRRT; PAM sequence: TAGGAT
agctggaaaaggaaaacatt

SEQ ID NO: 21035 - DNA, 20 bp, Artificial Sequence
  Description of Artificial Sequence: Synthetic oligonucleotide
  Target: ATXN1; (+) strand; PAM type: NNGRRT; PAM sequence: CTGAGT
acatttaggattatccatct

SEQ ID NO: 21036 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtcagtcttcagaggaaaaa

SEQ ID NO: 21037 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tcatttctgaaaactcattt

SEQ ID NO: 21038 - DNA, 20 bp, Artificial Sequence
  Description of Artificial Sequence: Synthetic oligonucleotide
  Target: ATXN1; (+) strand; PAM type: NNGRRT; PAM sequence: CAGAGT
actcatttgtgaatcaaaac

SEQ ID NO: 21039 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gtgactgagcattccaatga

SEQ ID NO: 21040 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aagacattccttcctgtcaa

SEQ ID NO: 21041 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tgatttaaaagttcaagatt

SEQ ID NO: 21042 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aagttcaagatttagaattt

SEQ ID NO: 21043 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctagattttttaaaaggttt

SEQ ID NO: 21044 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gacgtgagaaaataaaaaaa

SEQ ID NO: 21045 - DNA, 20 bp, Artificial Sequence
  Description of Artificial Sequence: Synthetic oligonucleotide
  Target: ATXN1; (+) strand; PAM type: NNGRRT; PAM sequence: GGGGGT
tcagtctcatcattgataga

SEQ ID NO: 21046 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ggggtacactctcagcactt

SEQ ID NO: 21047 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cagcactttgggatgccgag

SEQ ID NO: 21048 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggatgccgaggcgg

SEQ ID NO: 21049 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcag

SEQ ID NO: 21050 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactccagcctgggcga

SEQ ID NO: 21051 - DNA, 20 bp, Artificial Sequence
  Description of Artificial Sequence: Synthetic oligonucleotide
  Target: ATXN1; (+) strand; PAM type: NNGRRT; PAM sequence: GGGGGT
aaaataaaataaaataaaga

SEQ ID NO: 21052 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gtaaaaaaccataattgtct

SEQ ID NO: 21053 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aattgtctaagaattgctct

SEQ ID NO: 21054 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tttaaaaacttcaaatgaaa

SEQ ID NO: 21055 - DNA, 20 bp, Artificial Sequence
  Description of Artificial Sequence: Synthetic oligonucleotide
  Target: ATXN1; (+) strand; PAM type: NNGRRT; PAM sequence: CTGGAT
agagggtaagaaagaaccca

SEQ ID NO: 21056 - DNA, 20 bp, Artificial Sequence
  Description of Artificial Sequence: Synthetic oligonucleotide
  Target: ATXN1; (+) strand; PAM type: NNGRRT; PAM sequence: AGGAAT
taaatttatatctgctgtat

SEQ ID NO: 21057 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tctggaaaatgaggtgcaga

SEQ ID NO: 21058 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gagaggattaagtaacatgc

SEQ ID NO: 21059 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aatcccagcactttgggagg

SEQ ID NO: 21060 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggctgagtcag

SEQ ID NO: 21061 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggcggatcacttgaggtc

SEQ ID NO: 21062 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaaaaaaaaaaaaaaacag

SEQ ID NO: 21063 - DNA, 20 bp, Artificial Sequence
  Description of Artificial Sequence: Synthetic oligonucleotide
  Target: ATXN1; (+) strand; PAM type: NNGRRT; PAM sequence: CTGAGT
attagatcgataaatattta

SEQ ID NO: 21064 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ccaagtactgatttaggtac

SEQ ID NO: 21065 - DNA, 20 bp, Artificial Sequence
  Description of Artificial Sequence: Synthetic oligonucleotide
  Target: ATXN1; (+) strand; PAM type: NNGRRT; PAM sequence: CTGAAT
atcagagagctgaccaggaa

SEQ ID NO: 21066 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgaccaggaactgaattctt

SEQ ID NO: 21067 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gctaggggctctgtagcctc

SEQ ID NO: 21068 - DNA, 20 bp, Artificial Sequence
  Description of Artificial Sequence: Synthetic oligonucleotide
  Target: ATXN1; (+) strand; PAM type: NNGRRT; PAM sequence: TTGGAT
agggctgaggcaatccatac

SEQ ID NO: 21069 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tacagtgtagccaatgattc

SEQ ID NO: 21070 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aaaagctgtgatctgggagc

SEQ ID NO: 21071 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tattatagcaattaagcagc

SEQ ID NO: 21072 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caccactgttatgtatggaa

SEQ ID NO: 21073 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tatgtatggaaaggagtaaa

SEQ ID NO: 21074 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aaggagtaaagggaatgcga

SEQ ID NO: 21075 - DNA, 20 bp, Artificial Sequence
  Description of Artificial Sequence: Synthetic oligonucleotide
  Target: ATXN1; (+) strand; PAM type: NNGRRT; PAM sequence: TTGGGT
caggaaacatgtggcaggca

SEQ ID NO: 21076 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ttgggaagactgtatttact

SEQ ID NO: 21077 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ataaaaagatgctccacatt

SEQ ID NO: 21078 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ttatgaatcactagggaact

SEQ ID NO: 21079 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tgccaacagcagatgctggc

SEQ ID NO: 21080 - DNA, 20 bp, Artificial Sequence
  Description of Artificial Sequence: Synthetic oligonucleotide
  Target: ATXN1; (+) strand; PAM type: NNGRRT; PAM sequence: GCGGGT
ataggaactctcaagtcatt

SEQ ID NO: 21081 - DNA, 20 bp, Artificial Sequence
  Description of Artificial Sequence: Synthetic oligonucleotide
  Target: ATXN1; (+) strand; PAM type: NNGRRT; PAM sequence: GGGAAT
actctcaagtcattgcgggt

SEQ ID NO: 21082 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tagcagcttcattcataatc

SEQ ID NO: 21083 - DNA, 20 bp, Artificial Sequence
  Description of Artificial Sequence: Synthetic oligonucleotide
  Target: ATXN1; (+) strand; PAM type: NNGRRT; PAM sequence: ATGGGT
agcttcattcataatcgtga

SEQ ID NO: 21084 - DNA, 20 bp, Artificial Sequence
  Description of Artificial Sequence: Synthetic oligonucleotide
  Target: ATXN1; (+) strand; PAM type: NNGRRT; PAM sequence: TAGAAT
actgtggtacatccatacaa

SEQ ID NO: 21085 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ggtgaagccagctggacttc

SEQ ID NO: 21086 - DNA, 20 bp, Artificial Sequence
  Description of Artificial Sequence: Synthetic oligonucleotide
  Target: ATXN1; (+) strand; PAM type: NNGRRT; PAM sequence: TTGAGT
agccagctggacttcctggg

SEQ ID NO: 21087 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggaaatttcccgtcctacaa

SEQ ID NO: 21088 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgtaaaatgcaccaatcagc

SEQ ID NO: 21089 - DNA, 20 bp, Artificial Sequence
  Description of Artificial Sequence: Synthetic oligonucleotide
  Target: ATXN1; (+) strand; PAM type: NNGRRT; PAM sequence: GAGGAT
taaaagtagccaatcgcagg

SEQ ID NO: 21090 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gcactctgataggacagaaa

SEQ ID NO: 21091 - DNA, 20 bp, Artificial Sequence
  Description of Artificial Sequence: Synthetic oligonucleotide
  Target: ATXN1; (+) strand; PAM type: NNGRRT; PAM sequence: GGGAAT
atatgggaggggacaaataa

SEQ ID NO: 21092 - DNA, 20 bp, Artificial Sequence
  Description of Artificial Sequence: Synthetic oligonucleotide
  Target: ATXN1; (+) strand; PAM type: NNGRRT; PAM sequence: TTGGGT
agccagcagtggcaacccat

SEQ ID NO: 21093 - DNA, 20 bp, Artificial Sequence
  Description of Artificial Sequence: Synthetic oligonucleotide
  Target: ATXN1; (+) strand; PAM type: NNGRRT; PAM sequence: TTGGGT
accttgctactgctcactct

SEQ ID NO: 21094 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttcttgaagtcagcgagacc

SEQ ID NO: 21095 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ccaactctggacacatcttg

SEQ ID NO: 21096 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ctcccagatattgcaacgtg

SEQ ID NO: 21097 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tattctgtcctatttttcct

SEQ ID NO: 21098 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggccacaggactaaggac

SEQ ID NO: 21099 - DNA, 20 bp, Artificial Sequence
  Description of Artificial Sequence: Synthetic oligonucleotide
  Target: ATXN1; (+) strand; PAM type: NNGRRT; PAM sequence: TGGAGT
actaacaacccccgactgtt

SEQ ID NO: 21100 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ctgcacttccgggctaagcc

SEQ ID NO: 21101 - DNA, 20 bp, Artificial Sequence
  Description of Artificial Sequence: Synthetic oligonucleotide
  Target: ATXN1; (+) strand; PAM type: NNGRRT; PAM sequence: CGGGGT
agaggaaagccattcagctc

SEQ ID NO: 21102 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tctatcctgacccttgcctc

SEQ ID NO: 21103 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gctcttccagtttctcctat

SEQ ID NO: 21104 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ccctgttgtgggggactatc

SEQ ID NO: 21105 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tgggggactatctggaattt

SEQ ID NO: 21106 - DNA, 20 bp, Artificial Sequence
  Description of Artificial Sequence: Synthetic oligonucleotide
  Target: ATXN1; (+) strand; PAM type: NNGRRT; PAM sequence: TAGGAT
acaaaggctattcccaaagc

SEQ ID NO: 21107 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tggagatcccttccttccct

SEQ ID NO: 21108 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gcatattatctttatagtac

SEQ ID NO: 21109 - DNA, 20 bp, Artificial Sequence
  Description of Artificial Sequence: Synthetic oligonucleotide
  Target: ATXN1; (+) strand; PAM type: NNGRRT; PAM sequence: AAGAAT
taggactctaacaggttttc

SEQ ID NO: 21110 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gtggtctaaagacgaaaggc

SEQ ID NO: 21111 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aggcaagggtgcaggttttt

SEQ ID NO: 21112 - DNA, 20 bp, Artificial Sequence
  Description of Artificial Sequence: Synthetic oligonucleotide
  Target: ATXN1; (+) strand; PAM type: NNGRRT; PAM sequence: CAGGAT
agcacagctattccgaacag

SEQ ID NO: 21113 - DNA, 20 bp, Artificial Sequence
  Description of Artificial Sequence: Synthetic oligonucleotide
  Target: ATXN1; (+) strand; PAM type: NNGRRT; PAM sequence: GTGGGT
agcaggatccagggactgtt

SEQ ID NO: 21114 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctgtaagagggaagggaaa

SEQ ID NO: 21115 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tccaagctttctttttactg

SEQ ID NO: 21116 - DNA, 20 bp, Artificial Sequence
  Description of Artificial Sequence: Synthetic oligonucleotide
  Target: ATXN1; (+) strand; PAM type: NNGRRT; PAM sequence: GGGAAT
cctttaagctgtagggggag

SEQ ID NO: 21117 - DNA, 20 bp, Artificial Sequence
  Description of Artificial Sequence: Synthetic oligonucleotide
  Target: ATXN1; (+) strand; PAM type: NNGRRT; PAM sequence: CTGAAT
acatgggaccttctctctct

SEQ ID NO: 21118 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gtaggtatatagatgtccta

SEQ ID NO: 21119 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaccctggcctttaatgaa

SEQ ID NO: 21120 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgcagctttagctgcagccc

SEQ ID NO: 21121 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ggcagcaagccatccccatt

SEQ ID NO: 21122 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tagactcagatcatgggaac

SEQ ID NO: 21123 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgtattccagaaggactaag

SEQ ID NO: 21124 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ggagaattaggaaaaagccc

SEQ ID NO: 21125 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ccctgtcacccaactccctc

SEQ ID NO: 21126 - DNA, 20 bp, Artificial Sequence
  Description of Artificial Sequence: Synthetic oligonucleotide
  Target: ATXN1; (+) strand; PAM type: NNGRRT; PAM sequence: CGGGGT
atgccaaggcaatcactaga

SEQ ID NO: 21127 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gatgatccaacaacaggact

SEQ ID NO: 21128 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tcaagatccattaccatcca

SEQ ID NO: 21129 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aagctggagccattaactat

SEQ ID NO: 21130 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tgttgtcccctacttgagga

SEQ ID NO: 21131 - DNA, 20 bp, Artificial Sequence
  Description of Artificial Sequence: Synthetic oligonucleotide
  Target: ATXN1; (+) strand; PAM type: NNGRRT; PAM sequence: AAGGAT
cttaaggcctgaagctcata

SEQ ID NO: 21132 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctgaagctcataaaggatta

SEQ ID NO: 21133 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ccctgcaacaccccaattct

SEQ ID NO: 21134 - DNA, 20 bp, Artificial Sequence
  Description of Artificial Sequence: Synthetic oligonucleotide
  Target: ATXN1; (+) strand; PAM type: NNGRRT; PAM sequence: CTGAAT
caattctaggagtacaaaaa

SEQ ID NO: 21135 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctctcaaataccaaaggaag

SEQ ID NO: 21136 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gtttcactgttctggacctc

SEQ ID NO: 21137 - DNA, 20 bp, Artificial Sequence
  Description of Artificial Sequence: Synthetic oligonucleotide
  Target: ATXN1; (+) strand; PAM type: NNGRRT; PAM sequence: GAGGAT
cccagtttctctttgccttt

SEQ ID NO: 21138 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tacatggacggtcttgcctc

SEQ ID NO: 21139 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cggtcttgcctcaagggttt

SEQ ID NO: 21140 - DNA, 20 bp, Artificial Sequence
  Description of Artificial Sequence: Synthetic oligonucleotide
  Target: ATXN1; (+) strand; PAM type: NNGRRT; PAM sequence: GTGGAT
gcatgctggtccttcagtat

SEQ ID NO: 21141 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cttgaactttctagctaatc

SEQ ID NO: 21142 - DNA, 20 bp, Artificial Sequence
  Description of Artificial Sequence: Synthetic oligonucleotide
  Target: ATXN1; (+) strand; PAM type: NNGRRT; PAM sequence: GGGGGT
taacacattaaaacagttgt

SEQ ID NO: 21143 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aaacagttgtgggggttcct

SEQ ID NO: 21144 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atcactggcttttaccgact

SEQ ID NO: 21145 - DNA, 20 bp, Artificial Sequence
  Description of Artificial Sequence: Synthetic oligonucleotide
  Target: ATXN1; (+) strand; PAM type: NNGRRT; PAM sequence: CCGGAT
cttttaccgactatggatcc

SEQ ID NO: 21146 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gagggcaaatattcatctag

SEQ ID NO: 21147 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ttatacctcacagagagagc

SEQ ID NO: 21148 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gagagagcgggaatagctct

SEQ ID NO: 21149 - DNA, 20 bp, Artificial Sequence
  Description of Artificial Sequence: Synthetic oligonucleotide
  Target: ATXN1; (+) strand; PAM type: NNGRRT; PAM sequence: ACGGGT
aaaggctggcctcactgttt

SEQ ID NO: 21150 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ctatcaaaataatacaagga

SEQ ID NO: 21151 - DNA, 20 bp, Artificial Sequence
  Description of Artificial Sequence: Synthetic oligonucleotide
  Target: ATXN1; (+) strand; PAM type: NNGRRT; PAM sequence: GAGGAT
accctgctacttttctccca

SEQ ID NO: 21152 - DNA, 20 bp, Artificial Sequence
  Description of Artificial Sequence: Synthetic oligonucleotide
  Target: ATXN1; (+) strand; PAM type: NNGRRT; PAM sequence: TCGAGT
cccagaggatggagaaccaa

SEQ ID NO: 21153 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cccagacttatgcttcccaa

SEQ ID NO: 21154 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ccgatggaagttcatttgtg

SEQ ID NO: 21155 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ggaagttcatttgtggagaa

SEQ ID NO: 21156 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttagaaccgggaaaggaaaa

SEQ ID NO: 21157 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tgctgcaatatggaaagaaa

SEQ ID NO: 21158 - DNA, 20 bp, Artificial Sequence
  Description of Artificial Sequence: Synthetic oligonucleotide
  Target: ATXN1; (+) strand; PAM type: NNGRRT; PAM sequence: TGGAGT
taaataccacaaggaaatta

SEQ ID NO: 21159 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ccagtactccctgatcgaaa

SEQ ID NO: 21160 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ggggcatagttttctcccct

SEQ ID NO: 21161 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ccccctgccaaacttttcac

SEQ ID NO: 21162 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaggccccttttggggaaca

SEQ ID NO: 21163 - DNA, 20 bp, Artificial Sequence
  Description of Artificial Sequence: Synthetic oligonucleotide
  Target: ATXN1; (+) strand; PAM type: NNGRRT; PAM sequence: GGGGAT
cacccatatgcctaagtcaa

SEQ ID NO: 21164 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gtctgtgttgaccaaccaaa

SEQ ID NO: 21165 - DNA, 20 bp, Artificial Sequence
  Description of Artificial Sequence: Synthetic oligonucleotide
  Target: ATXN1; (+) strand; PAM type: NNGRRT; PAM sequence: GGGAAT
cttaaagccacggtaactca

SEQ ID NO: 21166 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cagggaatttccagggcact

SEQ ID NO: 21167 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctcttgcccatggccttgtt

SEQ ID NO: 21168 - DNA, 20 bp, Artificial Sequence
  Description of Artificial Sequence: Synthetic oligonucleotide
  Target: ATXN1; (+) strand; PAM type: NNGRRT; PAM sequence: ATGGAT
cagtccatatgaagtgctgt

SEQ ID NO: 21169 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aaacgttaaaaacctaccca

SEQ ID NO: 21170 - DNA, 20 bp, Artificial Sequence
  Description of Artificial Sequence: Synthetic oligonucleotide
  Target: ATXN1; (+) strand; PAM type: NNGRRT; PAM sequence: CAGAGT
atgtcacagagacaagggaa

SEQ ID NO: 21171 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tcccctcttcctcctcatct

SEQ ID NO: 21172 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cccactgcagttaaggtggc

SEQ ID NO: 21173 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgcagttaaggtggcaggag

SEQ ID NO: 21174 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aaggtggcaggagtggaatc

SEQ ID NO: 21175 - DNA, 20 bp, Artificial Sequence
  Description of Artificial Sequence: Synthetic oligonucleotide
  Target: ATXN1; (+) strand; PAM type: NNGRRT; PAM sequence: GCGAGT
gaatcttggattcactacat

SEQ ID NO: 21176 - DNA, 20 bp, Artificial Sequence
  Description of Artificial Sequence: Synthetic oligonucleotide
  Target: ATXN1; (+) strand; PAM type: NNGRRT; PAM sequence: AGGAGT
acctgtaggaccatcagctc

SEQ ID NO: 21177 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aaaactctttcctatttaaa

SEQ ID NO: 21178 - DNA, 20 bp, Artificial Sequence
  Description of Artificial Sequence: Synthetic oligonucleotide
  Target: ATXN1; (+) strand; PAM type: NNGRRT; PAM sequence: TGGAAT
accactccttgcccctttaa

SEQ ID NO: 21179 - DNA, 20 bp, Artificial Sequence
  Description of Artificial Sequence: Synthetic oligonucleotide
  Target: ATXN1; (+) strand; PAM type: NNGRRT; PAM sequence: GTGAAT
caatgaaaagccctgtaacc

SEQ ID NO: 21180 - DNA, 20 bp, Artificial Sequence
  Description of Artificial Sequence: Synthetic oligonucleotide
  Target: ATXN1; (+) strand; PAM type: NNGRRT; PAM sequence: AGGAAT
cagcagcacccccaccacta

SEQ ID NO: 21181 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cctctctttcaatcactctc

SEQ ID NO: 21182 - DNA, 20 bp, Artificial Sequence
  Description of Artificial Sequence: Synthetic oligonucleotide
  Target: ATXN1; (+) strand; PAM type: NNGRRT; PAM sequence: GGGAGT
caatgggaaaatagagcaca

SEQ ID NO: 21183 - DNA, 20 bp, Artificial Sequence
  Description of Artificial Sequence: Synthetic oligonucleotide
  Target: ATXN1; (+) strand; PAM type: NNGRRT; PAM sequence: AGGAGT
actaccttggcaagtactct

SEQ ID NO: 21184 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atacccctacttatacggtt

SEQ ID NO: 21185 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atagccactgctacaggaac

SEQ ID NO: 21186 - DNA, 20 bp, Artificial Sequence
  Description of Artificial Sequence: Synthetic oligonucleotide
  Target: ATXN1; (+) strand; PAM type: NNGRRT; PAM sequence: AAGGAT
cctactaccacacactctca

SEQ ID NO: 21187 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aaatagactctttggcagta

SEQ ID NO: 21188 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tgtttttacactaaccactc

SEQ ID NO: 21189 - DNA, 20 bp, Artificial Sequence
  Description of Artificial Sequence: Synthetic oligonucleotide
  Target: ATXN1; (+) strand; PAM type: NNGRRT; PAM sequence: TAGAGT
caaactcttataccaacctc

SEQ ID NO: 21190 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tttgtcaaatttgtttcctc

SEQ ID NO: 21191 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gacccaccagccctttggcc

SEQ ID NO: 21192 - DNA, 20 bp, Artificial Sequence
  Description of Artificial Sequence: Synthetic oligonucleotide
  Target: ATXN1; (+) strand; PAM type: NNGRRT; PAM sequence: TGGGGT
acccagttcccaacagcagc

SEQ ID NO: 21193 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tggggtgtcctgtttagagg

SEQ ID NO: 21194 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ggtgaggccagctggacttc

SEQ ID NO: 21195 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ggaactttcctgtcttacaa

SEQ ID NO: 21196 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctgtaaaatgcatcaatcag

SEQ ID NO: 21197 - DNA, 20 bp, Artificial Sequence
  Description of Artificial Sequence: Synthetic oligonucleotide
  Target: ATXN1; (+) strand; PAM type: NNGRRT; PAM sequence: GAGGAT
taaaggtagccaatcgcagg

SEQ ID NO: 21198 - DNA, 20 bp, Artificial Sequence
  Description of Artificial Sequence: Synthetic oligonucleotide
  Target: ATXN1; (+) strand; PAM type: NNGRRT; PAM sequence: GGGAAT
acatgggcagggacaaataa

SEQ ID NO: 21199 - DNA, 20 bp, Artificial Sequence
  Description of Artificial Sequence: Synthetic oligonucleotide
  Target: ATXN1; (+) strand; PAM type: NNGRRT; PAM sequence: TTGGGT
agccagcagcagcaacccac

SEQ ID NO: 21200 - DNA, 20 bp, Artificial Sequence
  Description of Artificial Sequence: Synthetic oligonucleotide
  Target: ATXN1; (+) strand; PAM type: NNGRRT; PAM sequence: TTGGGT
accttgctactgctcactct

SEQ ID NO: 21201 - DNA, 20 bp, Artificial Sequence
  Description of Artificial Sequence: Synthetic oligonucleotide
  Target: ATXN1; (+) strand; PAM type: NNGRRT; PAM sequence: AAGGGT
atgaaagaagccaatgtgaa

SEQ ID NO: 21202 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tttggaaaaggcaaagctac

SEQ ID NO: 21203 - DNA, 20 bp, Artificial Sequence
  Description of Artificial Sequence: Synthetic oligonucleotide
  Target: ATXN1; (+) strand; PAM type: NNGRRT; PAM sequence: AGGGGT
taaaaaaaaaaaaaaaaatc

SEQ ID NO: 21204 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aaaaaaaaatcaggggtttt

SEQ ID NO: 21205 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gaacaaataagcagagcaca

SEQ ID NO: 21206 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tgtcatctatttgtcaaaca

SEQ ID NO: 21207 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aacacagaatgtacaacagg

SEQ ID NO: 21208 - DNA, 20 bp, Artificial Sequence
  Description of Artificial Sequence: Synthetic oligonucleotide
  Target: ATXN1; (+) strand; PAM type: NNGRRT; PAM sequence: AGGGGT
cagtagggacactgtttgtc

SEQ ID NO: 21209 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tgtcaggggtcggggaggct

SEQ ID NO: 21210 - DNA, 20 bp, Artificial Sequence
  Description of Artificial Sequence: Synthetic oligonucleotide
  Target: ATXN1; (+) strand; PAM type: NNGRRT; PAM sequence: TGGAAT
agatactagctagagccaag

SEQ ID NO: 21211 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aatcaggcaaggtgcaacgg

SEQ ID NO: 21212 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggaggctgaggcag

SEQ ID NO: 21213 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcgtgccactgcactccagc

SEQ ID NO: 21214 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgcactccagcctgggtgac

SEQ ID NO: 21215 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gttttttggccaagaactag

SEQ ID NO: 21216 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gaggatgcaatgattcagat

SEQ ID NO: 21217 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gatggggatgagggcaaggg

SEQ ID NO: 21218 - DNA, 20 bp, Artificial Sequence
  Description of Artificial Sequence: Synthetic oligonucleotide
  Target: ATXN1; (+) strand; PAM type: NNGRRT; PAM sequence: TGGGGT
atgagggcaagggcagggtc

SEQ ID NO: 21219 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ggcaagggcagggtctgggg

SEQ ID NO: 21220 - DNA, 20 bp, Artificial Sequence
  Description of Artificial Sequence: Synthetic oligonucleotide
  Target: ATXN1; (+) strand; PAM type: NNGRRT; PAM sequence: ATGAAT
agggcagggtctggggtggg

SEQ ID NO: 21221 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ggtgggatgaatgcatgggg

SEQ ID NO: 21222 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttaaaatgaaatctgaaaga

SEQ ID NO: 21223 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ggcccactacaggtgaggtc

SEQ ID NO: 21224 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggaaagtaaacagaaaatac

SEQ ID NO: 21225 - DNA, 20 bp, Artificial Sequence
  Description of Artificial Sequence: Synthetic oligonucleotide
  Target: ATXN1; (+) strand; PAM type: NNGRRT; PAM sequence: GGGAAT
agaaaatacaaggattctaa

SEQ ID NO: 21226 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ccaggaagctgagatggaag

SEQ ID NO: 21227 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cagcactttgggaggccaag

SEQ ID NO: 21228 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactagggaggctgaggcag

SEQ ID NO: 21229 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttgcgccactgcactccagt

SEQ ID NO: 21230 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactccagtctgggtga

SEQ ID NO: 21231 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aatgtcaggagggaacccaa

SEQ ID NO: 21232 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gaggataactctctatcaag

SEQ ID NO: 21233 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttcctagatttcttctcttt

SEQ ID NO: 21234 - DNA, 20 bp, Artificial Sequence
  Description of Artificial Sequence: Synthetic oligonucleotide
  Target: ATXN1; (+) strand; PAM type: NNGRRT; PAM sequence: TAGGAT
aattctcatctgatcatatt

SEQ ID NO: 21235 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tttctcttcaagctattaca

SEQ ID NO: 21236 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aagactaatgttttcaatga

SEQ ID NO: 21237 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ccaataacgtcttcctcgct

SEQ ID NO: 21238 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aacgtcttcctcgctgaggg

SEQ ID NO: 21239 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tgatgcacaagggaaaacaa

SEQ ID NO: 21240 - DNA, 20 bp, Artificial Sequence
  Description of Artificial Sequence: Synthetic oligonucleotide
  Target: ATXN1; (+) strand; PAM type: NNGRRT; PAM sequence: AGGAGT
aagtcacaaaaagtaatgga

SEQ ID NO: 21241 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tgatgcaaattatgtatgaa

SEQ ID NO: 21242 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gaggatgcagcgatgtggcc

SEQ ID NO: 21243 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gctttacatgcagaggaggg

SEQ ID NO: 21244 - DNA, 20 bp, Artificial Sequence
  Description of Artificial Sequence: Synthetic oligonucleotide
  Target: ATXN1; (+) strand; PAM type: NNGRRT; PAM sequence: TCGGGT
agggaggagtgtgtgtttct

SEQ ID NO: 21245 - DNA, 20 bp, Artificial Sequence
  Description of Artificial Sequence: Synthetic oligonucleotide
  Target: ATXN1; (+) strand; PAM type: NNGRRT; PAM sequence: GGGGAT
agtgtgtgtttcttcgggtg

SEQ ID NO: 21246 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caatcctattgcattaatgt

SEQ ID NO: 21247 - DNA, 20 bp, Artificial Sequence
  Description of Artificial Sequence: Synthetic oligonucleotide
  Target: ATXN1; (+) strand; PAM type: NNGRRT; PAM sequence: ACGGAT
tttcctgttctctgtaaaac

SEQ ID NO: 21248 - DNA, 20 bp, Artificial Sequence
  Description of Artificial Sequence: Synthetic oligonucleotide
  Target: ATXN1; (+) strand; PAM type: NNGRRT; PAM sequence: TCGAAT
ctatttctatctagtgacca

SEQ ID NO: 21249 - DNA, 20 bp, Artificial Sequence
  Description of Artificial Sequence: Synthetic oligonucleotide
  Target: ATXN1; (+) strand; PAM type: NNGRRT; PAM sequence: GGGAAT
acttgtttacctattaaata

SEQ ID NO: 21250 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ggaattatagcaataatcat

SEQ ID NO: 21251 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gtggcagtaacaataaaaac

SEQ ID NO: 21252 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctgaggctagagactaaagt

SEQ ID NO: 21253 - DNA, 20 bp, Artificial Sequence
  Description of Artificial Sequence: Synthetic oligonucleotide
  Target: ATXN1; (+) strand; PAM type: NNGRRT; PAM sequence: CGGAGT
tattttattttattttgaga

SEQ ID NO: 21254 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcgcccaggc

SEQ ID NO: 21255 - DNA, 20 bp, Artificial Sequence
  Description of Artificial Sequence: Synthetic oligonucleotide
  Target: ATXN1; (+) strand; PAM type: NNGRRT; PAM sequence: CTGAGT
cattctcccgcctcagcctc

SEQ ID NO: 21256 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttttgtatttttagtagaga

SEQ ID NO: 21257 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cggggtttcactgtgttagt

SEQ ID NO: 21258 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcggcctcctaaagtgc

SEQ ID NO: 21259 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aagtaccatcaaattgttat

SEQ ID NO: 21260 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tgtttccagggaagccactg

SEQ ID NO: 21261 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tccagggaagccactgtggg

SEQ ID NO: 21262 - DNA, 20 bp, Artificial Sequence
  Description of Artificial Sequence: Synthetic oligonucleotide
  Target: ATXN1; (+) strand; PAM type: NNGRRT; PAM sequence: GCGAGT
acagtcactggaaccagtaa

SEQ ID NO: 21263 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gtatatgctatccctgggct

SEQ ID NO: 21264 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gattgttaacaatgtcctaa

SEQ ID NO: 21265 - DNA, 20 bp, Artificial Sequence
  Description of Artificial Sequence: Synthetic oligonucleotide
  Target: ATXN1; (+) strand; PAM type: NNGRRT; PAM sequence: GAGAAT
agagaagttttcagatgctt

SEQ ID NO: 21266 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tacttagatcgatgcttctt

SEQ ID NO: 21267 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gtccaaaccttctagaaagg

SEQ ID NO: 21268 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gggcacccaataaatgcttg

SEQ ID NO: 21269 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aataaatgcttgatgaataa

SEQ ID NO: 21270 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttgatgaataaatgagtgaa

SEQ ID NO: 21271 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgaataaatgagtgaaatga

SEQ ID NO: 21272 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taaatgagtgaaatgaatga

SEQ ID NO: 21273 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atgaatgaatgaatgcatga

SEQ ID NO: 21274 - DNA, 20 bp, Artificial Sequence
  Description of Artificial Sequence: Synthetic oligonucleotide
  Target: ATXN1; (+) strand; PAM type: NNGRRT; PAM sequence: ATGAGT
atgaatgaatgcatgaaaga

SEQ ID NO: 21275 - DNA, 20 bp, Artificial Sequence
  Description of Artificial Sequence: Synthetic oligonucleotide
  Target: ATXN1; (+) strand; PAM type: NNGRRT; PAM sequence: GTGAGT
atgaatgcatgaaagaatga

SEQ ID NO: 21276 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aaaaccaacagcaattatac

SEQ ID NO: 21277 - DNA, 20 bp, Artificial Sequence
  Description of Artificial Sequence: Synthetic oligonucleotide
  Target: ATXN1; (+) strand; PAM type: NNGRRT; PAM sequence: AGGGGT
aattagtgaagaactaggca

SEQ ID NO: 21278 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gttaaagaaagcttctaaga

SEQ ID NO: 21279 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cttatctgtggcctctgccc

SEQ ID NO: 21280 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tcaggaaagaggtcagcaga

SEQ ID NO: 21281 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atcatgaaaaaaggttcaaa

SEQ ID NO: 21282 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tatctaataaagacgtgaaa

SEQ ID NO: 21283 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tgaaagagagttggtgaaga

SEQ ID NO: 21284 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caggcagatcacctgaggtc

SEQ ID NO: 21285 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tacttgggaggctgaggcaa

SEQ ID NO: 21286 - DNA, 20 bp, Artificial Sequence
  Description of Artificial Sequence: Synthetic oligonucleotide
  Target: ATXN1; (+) strand; PAM type: NNGRRT; PAM sequence: GAGAGT
aaaaaaaaaaaagaaaaaga

SEQ ID NO: 21287 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaaagaaaaagagagagttg

SEQ ID NO: 21288 - DNA, 20 bp, Artificial Sequence
  Description of Artificial Sequence: Synthetic oligonucleotide
  Target: ATXN1; (+) strand; PAM type: NNGRRT; PAM sequence: AAGAGT
agagttgatgaatggtttca

SEQ ID NO: 21289 - DNA, 20 bp, Artificial Sequence
  Description of Artificial Sequence: Synthetic oligonucleotide
  Target: ATXN1; (+) strand; PAM type: NNGRRT; PAM sequence: AAGGAT
caagtgcccactgatagatg

SEQ ID NO: 21290 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aatgtggtctacacatacaa

SEQ ID NO: 21291 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tcaaaataatagacagcaag

SEQ ID NO: 21292 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gaatggtggctgccgggggc

SEQ ID NO: 21293 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ggctgccgggggctagggtg

SEQ ID NO: 21294 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gggtagagcattagtatttt

SEQ ID NO: 21295 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ggagatggcttcacatcaat

SEQ ID NO: 21296 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gaaagttattggacagaagt

SEQ ID NO: 21297 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gttattggacagaagtcaga

SEQ ID NO: 21298 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gacacccaaaagatctcccc

SEQ ID NO: 21299 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actttgggaggtcaagacag

SEQ ID NO: 21300 - DNA, 20 bp, Artificial Sequence
  Description of Artificial Sequence: Synthetic oligonucleotide
  Target: ATXN1; (+) strand; PAM type: NNGRRT; PAM sequence: GGGAGT
aggaggatcacttgaggcca

SEQ ID NO: 21301 - DNA, 20 bp, Artificial Sequence
  Description of Artificial Sequence: Synthetic oligonucleotide
  Target: ATXN1; (+) strand; PAM type: NNGRRT; PAM sequence: GTGAGT
atcacttgaggccagggagt

SEQ ID NO: 21302 - DNA, 20 bp, Artificial Sequence
  Description of Artificial Sequence: Synthetic oligonucleotide
  Target: ATXN1; (+) strand; PAM type: NNGRRT; PAM sequence: GTGAGT
aaggtctctatcagcttaat

SEQ ID NO: 21303 - DNA, 20 bp, Artificial Sequence
  Description of Artificial Sequence: Synthetic oligonucleotide
  Target: ATXN1; (+) strand; PAM type: NNGRRT; PAM sequence: GAGAGT
attcgtctggaaagggaaca

SEQ ID NO: 21304 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gttaatcacaggaagtaatt

SEQ ID NO: 21305 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tgccttagagctcggcattc

SEQ ID NO: 21306 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gcattcctgagtttgctgca

SEQ ID NO: 21307 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gcaatgagtagttaagtttg

SEQ ID NO: 21308 - DNA, 20 bp, Artificial Sequence
  Description of Artificial Sequence: Synthetic oligonucleotide
  Target: ATXN1; (+) strand; PAM type: NNGRRT; PAM sequence: GTGAAT
agtttgaagaatctagatat

SEQ ID NO: 21309 - DNA, 20 bp, Artificial Sequence
  Description of Artificial Sequence: Synthetic oligonucleotide
  Target: ATXN1; (+) strand; PAM type: NNGRRT; PAM sequence: TTGGAT
taatagataaggcagacaga

SEQ ID NO: 21310 - DNA, 20 bp, Artificial Sequence
  Description of Artificial Sequence: Synthetic oligonucleotide
  Target: ATXN1; (+) strand; PAM type: NNGRRT; PAM sequence: AGGGGT
aggcagacagattggatcag

SEQ ID NO: 21311 - DNA, 20 bp, Artificial Sequence
  Description of Artificial Sequence: Synthetic oligonucleotide
  Target: ATXN1; (+) strand; PAM type: NNGRRT; PAM sequence: TAGAGT
atgaccttatgcctatatca

SEQ ID NO: 21312 - DNA, 20 bp, Artificial Sequence
  Description of Artificial Sequence: Synthetic oligonucleotide
  Target: ATXN1; (+) strand; PAM type: NNGRRT; PAM sequence: CTGGAT
atgcaaagcagccatgtgcc

SEQ ID NO: 21313 - DNA, 20 bp, Artificial Sequence
  Description of Artificial Sequence: Synthetic oligonucleotide
  Target: ATXN1; (+) strand; PAM type: NNGRRT; PAM sequence: AGGAGT
agctttcagtagagcatgtc

SEQ ID NO: 21314 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gtgtgtgagacagaaagaga

SEQ ID NO: 21315 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gtctgtcattgtaatataca

SEQ ID NO: 21316 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gttggaagagcaacaacaat

SEQ ID NO: 21317 - DNA, 20 bp, Artificial Sequence
  Description of Artificial Sequence: Synthetic oligonucleotide
  Target: ATXN1; (+) strand; PAM type: NNGRRT; PAM sequence: CGGAAT
atttttctttataagacact

SEQ ID NO: 21318 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tacccatgtccctggcagct

SEQ ID NO: 21319 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aggtaacatacaaagtgcag

SEQ ID NO: 21320 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgtttgtacagcacaaaaca

SEQ ID NO: 21321 - DNA, 20 bp, Artificial Sequence
  Description of Artificial Sequence: Synthetic oligonucleotide
  Target: ATXN1; (+) strand; PAM type: NNGRRT; PAM sequence: TTGGGT
gtacagcacaaaacatggaa

SEQ ID NO: 21322 - DNA, 20 bp, Artificial Sequence
  Description of Artificial Sequence: Synthetic oligonucleotide
  Target: ATXN1; (+) strand; PAM type: NNGRRT; PAM sequence: TAGAAT
accatatcttcctttcagta

SEQ ID NO: 21323 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tcctttcagtatagaatgca

SEQ ID NO: 21324 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctgctattaaagcaaataag

SEQ ID NO: 21325 - DNA, 20 bp, Artificial Sequence
  Description of Artificial Sequence: Synthetic oligonucleotide
  Target: ATXN1; (+) strand; PAM type: NNGRRT; PAM sequence: AGGAAT
taaagcaaataagcagaatc

SEQ ID NO: 21326 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tgttttcatttccatttcac

SEQ ID NO: 21327 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tgcaggctccgagcatgccc

SEQ ID NO: 21328 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gtgataagacatggcacgca

SEQ ID NO: 21329 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tgccagagcagaaccctgca

SEQ ID NO: 21330 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tctttgattggagaaaaggt

SEQ ID NO: 21331 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tgcccctggaagattaggtc

SEQ ID NO: 21332 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tccctcaaggaaaagagcat

SEQ ID NO: 21333 - DNA, 20 bp, Artificial Sequence
  Description of Artificial Sequence: Synthetic oligonucleotide
  Target: ATXN1; (+) strand; PAM type: NNGRRT; PAM sequence: TTGAGT
aaagataccacttccaacat

SEQ ID NO: 21334 - DNA, 20 bp, Artificial Sequence
  Description of Artificial Sequence: Synthetic oligonucleotide
  Target: ATXN1; (+) strand; PAM type: NNGRRT; PAM sequence: TTGAAT
acgttctcactcttggcgac

SEQ ID NO: 21335 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tttctatttttgccttttga

SEQ ID NO: 21336 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aaggtcagatctggaaatta

SEQ ID NO: 21337 - DNA, 20 bp, Artificial Sequence
  Description of Artificial Sequence: Synthetic oligonucleotide
  Target: ATXN1; (+) strand; PAM type: NNGRRT; PAM sequence: GAGAGT
cgaggtcagagaagcatttt

SEQ ID NO: 21338 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gaaaaacatgttggaaggaa

SEQ ID NO: 21339 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ggaaggaaaagagtctttgg

SEQ ID NO: 21340 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aagaagacacttccagagac

SEQ ID NO: 21341 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tatttagaacccaaggacat

SEQ ID NO: 21342 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ccaaggacattggagtctgg

SEQ ID NO: 21343 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agcgaggtgaggaacactgg

SEQ ID NO: 21344 - DNA, 20 bp, Artificial Sequence
  Description of Artificial Sequence: Synthetic oligonucleotide
  Target: ATXN1; (+) strand; PAM type: NNGRRT; PAM sequence: ACGGAT
agttctcccaccagattcat

SEQ ID NO: 21345 - DNA, 20 bp, Artificial Sequence
  Description of Artificial Sequence: Synthetic oligonucleotide
  Target: ATXN1; (+) strand; PAM type: NNGRRT; PAM sequence: CTGGGT
catcttctcctatgctatcc

SEQ ID NO: 21346 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtcatctctttggaaacttc

SEQ ID NO: 21347 - DNA, 20 bp, Artificial Sequence
  Description of Artificial Sequence: Synthetic oligonucleotide
  Target: ATXN1; (+) strand; PAM type: NNGRRT; PAM sequence: ACGAGT
ttcctgaattgtctaggcta

SEQ ID NO: 21348 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tgtcctcatgtgactagagc

SEQ ID NO: 21349 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aagctcagactagtctactg

SEQ ID NO: 21350 - DNA, 20 bp, Artificial Sequence
  Description of Artificial Sequence: Synthetic oligonucleotide
  Target: ATXN1; (+) strand; PAM type: NNGRRT; PAM sequence: GTGAGT
accagccttctagtagctat

SEQ ID NO: 21351 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gctatgtgagtgagaccatg

SEQ ID NO: 21352 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tggtcttggcccttaactgt

SEQ ID NO: 21353 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tctactcctcattcaagtct

SEQ ID NO: 21354 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gtctgcatccatggcaacct

SEQ ID NO: 21355 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gagagctggtcatggtgtaa

SEQ ID NO: 21356 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tatttgctgaaagaagatac

SEQ ID NO: 21357 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttcttctatcctaaatttca

SEQ ID NO: 21358 - DNA, 20 bp, Artificial Sequence
  Description of Artificial Sequence: Synthetic oligonucleotide
  Target: ATXN1; (+) strand; PAM type: NNGRRT; PAM sequence: CAGAGT
attttaatgttttacttttt

SEQ ID NO: 21359 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tactcatatcaacagccttt

SEQ ID NO: 21360 - DNA, 20 bp, Artificial Sequence
  Description of Artificial Sequence: Synthetic oligonucleotide
  Target: ATXN1; (+) strand; PAM type: NNGRRT; PAM sequence: ATGGAT
agggccctcagcatatgcac

SEQ ID NO: 21361 - DNA, 20 bp, Artificial Sequence
  Description of Artificial Sequence: Synthetic oligonucleotide
  Target: ATXN1; (+) strand; PAM type: NNGRRT; PAM sequence: CCGAAT
aaggtcttaacaatacataa

SEQ ID NO: 21362 - DNA, 20 bp, Artificial Sequence
  Description of Artificial Sequence: Synthetic oligonucleotide
  Target: ATXN1; (+) strand; PAM type: NNGRRT; PAM sequence: CAGGGT
taactctcttaacaggtcat

SEQ ID NO: 21363 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcccaaaggacacacagcta

SEQ ID NO: 21364 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctgaacccaaatgtgattca

SEQ ID NO: 21365 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gaaatagaggcacccagata

SEQ ID NO: 21366 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tgccactggtctaaaagggc

SEQ ID NO: 21367 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttttttttttttttttgaga

SEQ ID NO: 21368 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgttacccagac

SEQ ID NO: 21369 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ctcactgcaacctccacctc

SEQ ID NO: 21370 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gattctcctgcctcagcctc

SEQ ID NO: 21371 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gccttggcttcccaaagtgc

SEQ ID NO: 21372 - DNA, 20 bp, Artificial Sequence
  Description of Artificial Sequence: Synthetic oligonucleotide
  Target: ATXN1; (+) strand; PAM type: NNGRRT; PAM sequence: AAGGGT
acgacaacttattcaggaag

SEQ ID NO: 21373 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tagctaggttgtgaaaagaa

SEQ ID NO: 21374 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agcaaccatcaaacccagag

SEQ ID NO: 21375 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tttatgacctgtgcactata

SEQ ID NO: 21376 - DNA, 20 bp, Artificial Sequence
  Description of Artificial Sequence: Synthetic oligonucleotide
  Target: ATXN1; (+) strand; PAM type: NNGRRT; PAM sequence: ATGAGT
cctgtgcactataaagaatg

SEQ ID NO: 21377 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gagtatttaaacactaagtg

SEQ ID NO: 21378 - DNA, 20 bp, Artificial Sequence
  Description of Artificial Sequence: Synthetic oligonucleotide
  Target: ATXN1; (+) strand; PAM type: NNGRRT; PAM sequence: AGGAAT
taataggtatttattgtttc

SEQ ID NO: 21379 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tacaaaacatcctgaaaata

SEQ ID NO: 21380 - DNA, 20 bp, Artificial Sequence
  Description of Artificial Sequence: Synthetic oligonucleotide
  Target: ATXN1; (+) strand; PAM type: NNGRRT; PAM sequence: TGGAGT
aaagtgccaacagctaccct

SEQ ID NO: 21381 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cttatttcagctatggtaga

SEQ ID NO: 21382 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tttcagctatggtagaagga

SEQ ID NO: 21383 - DNA, 20 bp, Artificial Sequence
  Description of Artificial Sequence: Synthetic oligonucleotide
  Target: ATXN1; (+) strand; PAM type: NNGRRT; PAM sequence: TTGAGT
aggagtgaatataccttctg

SEQ ID NO: 21384 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tttcatgcaattatctcgac

SEQ ID NO: 21385 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cgtcatacttcctgtcatct

SEQ ID NO: 21386 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tttccttgcaaagacccacc

SEQ ID NO: 21387 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ccacagtatttctatgttct

SEQ ID NO: 21388 - DNA, 20 bp, Artificial Sequence
  Description of Artificial Sequence: Synthetic oligonucleotide
  Target: ATXN1; (+) strand; PAM type: NNGRRT; PAM sequence: CTGGGT
agccatattcctcttcaagg

SEQ ID NO: 21389 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tcctcttcaaggctgggtgc

SEQ ID NO: 21390 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gtaagaaggctctcgttaca

SEQ ID NO: 21391 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aattcatttgttattctccg

SEQ ID NO: 21392 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tcaccagtggggctaggaac

SEQ ID NO: 21393 - DNA, 20 bp, Artificial Sequence
  Description of Artificial Sequence: Synthetic oligonucleotide
  Target: ATXN1; (+) strand; PAM type: NNGRRT; PAM sequence: CCGAGT
ctgtcccctatagcaagtga

SEQ ID NO: 21394 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aggagctgcatgactctgtt

SEQ ID NO: 21395 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ggcttgccatggttgaagaa

SEQ ID NO: 21396 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gcccagttctctttgttctg

SEQ ID NO: 21397 - DNA, 20 bp, Artificial Sequence
  Description of Artificial Sequence: Synthetic oligonucleotide
  Target: ATXN1; (+) strand; PAM type: NNGRRT; PAM sequence: GTGAGT
agttctctttgttctgcagg

SEQ ID NO: 21398 - DNA, 20 bp, Artificial Sequence
  Description of Artificial Sequence: Synthetic oligonucleotide
  Target: ATXN1; (+) strand; PAM type: NNGRRT; PAM sequence: ACGGGT
tgagttttacaatgcttata

SEQ ID NO: 21399 - DNA, 20 bp, Artificial Sequence
  Description of Artificial Sequence: Synthetic oligonucleotide
  Target: ATXN1; (+) strand; PAM type: NNGRRT; PAM sequence: TTGGAT
taagactgcctatcaaagtc

SEQ ID NO: 21400 - DNA, 20 bp, Artificial Sequence
  Description of Artificial Sequence: Synthetic oligonucleotide
  Target: ATXN1; (+) strand; PAM type: NNGRRT; PAM sequence: GAGGAT
atgcacaaaggaaggctggt

SEQ ID NO: 21401 - DNA, 20 bp, Artificial Sequence
  Description of Artificial Sequence: Synthetic oligonucleotide
  Target: ATXN1; (+) strand; PAM type: NNGRRT; PAM sequence: AGGGGT
caacagcctgggacctgtgc

SEQ ID NO: 21402 - DNA, 20 bp, Artificial Sequence
  Description of Artificial Sequence: Synthetic oligonucleotide
  Target: ATXN1; (+) strand; PAM type: NNGRRT; PAM sequence: GCGAAT
acctgtgcaggggtccagca

SEQ ID NO: 21403 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aaaatgtattgagaaagaag

SEQ ID NO: 21404 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aaaagtagaagaagatggtt

SEQ ID NO: 21405 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gcatgatgataaaaacctgt

SEQ ID NO: 21406 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ggaaataaaagattatgata

SEQ ID NO: 21407 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctccttaagcaagttgtttc

SEQ ID NO: 21408 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cttgtcaaaaatgacttttt

SEQ ID NO: 21409 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gaaaaggttaacataatctt

SEQ ID NO: 21410 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atcttcaggatttatagaag

SEQ ID NO: 21411 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gctaccactggaaatttaac

SEQ ID NO: 21412 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gtctgtttacattagtccta

SEQ ID NO: 21413 - DNA, 20 bp, Artificial Sequence
  Description of Artificial Sequence: Synthetic oligonucleotide
  Target: ATXN1; (+) strand; PAM type: NNGRRT; PAM sequence: TTGGGT
taagaaccaatagattttgt

SEQ ID NO: 21414 - DNA, 20 bp, Artificial Sequence
  Description of Artificial Sequence: Synthetic oligonucleotide
  Target: ATXN1; (+) strand; PAM type: NNGRRT; PAM sequence: GTGGAT
catccctgcccttctttatt

SEQ ID NO: 21415 - DNA, 20 bp, Artificial Sequence
  Description of Artificial Sequence: Synthetic oligonucleotide
  Target: ATXN1; (+) strand; PAM type: NNGRRT; PAM sequence: TCGAAT
attcttgaacattgagcact

SEQ ID NO: 21416 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aaatacatctttagttttgt

SEQ ID NO: 21417 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgggcagatcacttgagctc

SEQ ID NO: 21418 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggaggctgaggcag

SEQ ID NO: 21419 - DNA, 20 bp, Artificial Sequence
  Description of Artificial Sequence: Synthetic oligonucleotide
  Target: ATXN1; (+) strand; PAM type: NNGRRT; PAM sequence: GTGAGT
cccagaaggtggaggttgca

SEQ ID NO: 21420 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tctctaaatacacatatata

SEQ ID NO: 21421 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tccttcccatagcaccttcc

SEQ ID NO: 21422 - DNA, 20 bp, Artificial Sequence
  Description of Artificial Sequence: Synthetic oligonucleotide
  Target: ATXN1; (+) strand; PAM type: NNGRRT; PAM sequence: CTGGAT
taagtacagattactcagcc

SEQ ID NO: 21423 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ttttaataaatatcatgtaa

SEQ ID NO: 21424 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cttttttccttccacaacgt

SEQ ID NO: 21425 - DNA, 20 bp, Artificial Sequence
  Description of Artificial Sequence: Synthetic oligonucleotide
  Target: ATXN1; (+) strand; PAM type: NNGRRT; PAM sequence: CTGAGT
caagatgctgagaggaggag

SEQ ID NO: 21426 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ggaagaaggtgctgagggga

SEQ ID NO: 21427 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ctgaggggaaagggtgtgcc

SEQ ID NO: 21428 - DNA, 20 bp, Artificial Sequence
  Description of Artificial Sequence: Synthetic oligonucleotide
  Target: ATXN1; (+) strand; PAM type: NNGRRT; PAM sequence: ATGGGT
agtctgaggaagagagagaa

SEQ ID NO: 21429 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tgaagctatccccagtgcac

SEQ ID NO: 21430 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ctatccccagtgcacttgga

SEQ ID NO: 21431 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tctgcaggagcattacaagc

SEQ ID NO: 21432 - DNA, 20 bp, Artificial Sequence
  Description of Artificial Sequence: Synthetic oligonucleotide
  Target: ATXN1; (+) strand; PAM type: NNGRRT; PAM sequence: TGGAAT
cctcacttgtccaaaagtgg

SEQ ID NO: 21433 - DNA, 20 bp, Artificial Sequence
  Description of Artificial Sequence: Synthetic oligonucleotide
  Target: ATXN1; (+) strand; PAM type: NNGRRT; PAM sequence: GAGAAT
attttttttttgtaacgctg

SEQ ID NO: 21434 - DNA, 20 bp, Artificial Sequence
  Description of Artificial Sequence: Synthetic oligonucleotide
  Target: ATXN1; (+) strand; PAM type: NNGRRT; PAM sequence: TAGAGT
aattcccagattgctcttat

SEQ ID NO: 21435 - DNA, 20 bp, Artificial Sequence
  Description of Artificial Sequence: Synthetic oligonucleotide
  Target: ATXN1; (+) strand; PAM type: NNGRRT; PAM sequence: CAGAGT
attctcttagtctggagatt

SEQ ID NO: 21436 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tagtctctccatttcttcct

SEQ ID NO: 21437 - DNA, 20 bp, Artificial Sequence
  Description of Artificial Sequence: Synthetic oligonucleotide
  Target: ATXN1; (+) strand; PAM type: NNGRRT; PAM sequence: GGGAGT
cagagcagttattctgaaaa

SEQ ID NO: 21438 - DNA, 20 bp, Artificial Sequence
  Description of Artificial Sequence: Synthetic oligonucleotide
  Target: ATXN1; (+) strand; PAM type: NNGRRT; PAM sequence: ATGGGT
acacaccacagagacattaa

SEQ ID NO: 21439 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tttcattctaaggtgtgcac

SEQ ID NO: 21440 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ccgttcacagaaagccaggg

SEQ ID NO: 21441 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ccaaactctactgataggtc

SEQ ID NO: 21442 - DNA, 20 bp, Artificial Sequence
  Description of Artificial Sequence: Synthetic oligonucleotide
  Target: ATXN1; (+) strand; PAM type: NNGRRT; PAM sequence: GTGAAT
acatgagaggcattcactta

SEQ ID NO: 21443 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gtcatttaggcattcactca

SEQ ID NO: 21444 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gtactattcattcaccaggg

SEQ ID NO: 21445 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttcattcaccagggaagaat

SEQ ID NO: 21446 - DNA, 20 bp, Artificial Sequence
  Description of Artificial Sequence: Synthetic oligonucleotide
  Target: ATXN1; (+) strand; PAM type: NNGRRT; PAM sequence: GAGAAT
caccagggaagaataagaat

SEQ ID NO: 21447 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggaagaataagaatgagaat

SEQ ID NO: 21448 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ataagaatgagaataaggat

SEQ ID NO: 21449 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cagaaggctagaggactgag

SEQ ID NO: 21450 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ggctagaggactgagaggga

SEQ ID NO: 21451 - DNA, 20 bp, Artificial Sequence
  Description of Artificial Sequence: Synthetic oligonucleotide
  Target: ATXN1; (+) strand; PAM type: NNGRRT; PAM sequence: GTGGAT
agaggactgagagggatggg

SEQ ID NO: 21452 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctgctttgataaggtaactc

SEQ ID NO: 21453 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ttaaggaagcagagaagctt

SEQ ID NO: 21454 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gagaagcttaggaatgaaat

SEQ ID NO: 21455 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gtttattttcaaaaggacca

SEQ ID NO: 21456 - DNA, 20 bp, Artificial Sequence
  Description of Artificial Sequence: Synthetic oligonucleotide
  Target: ATXN1; (+) strand; PAM type: NNGRRT; PAM sequence: TTGAAT
acagtctcaaataaatacct

SEQ ID NO: 21457 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aattgtcatatggtgcccag

SEQ ID NO: 21458 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gcccaggagggtcttgtgga

SEQ ID NO: 21459 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tttatgcaacttgagacact

SEQ ID NO: 21460 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ctcaagttgtccatcataaa

SEQ ID NO: 21461 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aaaatccaggtctgctaact

SEQ ID NO: 21462 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gcagttaatgggacatgcac

SEQ ID NO: 21463 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttaatgggacatgcacagga

SEQ ID NO: 21464 - DNA, 20 bp, Artificial Sequence
  Description of Artificial Sequence: Synthetic oligonucleotide
  Target: ATXN1; (+) strand; PAM type: NNGRRT; PAM sequence: AGGAGT
catgcacaggaatgaatgcc

SEQ ID NO: 21465 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gaaagtacttagcatgcaca

SEQ ID NO: 21466 - DNA, 20 bp, Artificial Sequence
  Description of Artificial Sequence: Synthetic oligonucleotide
  Target: ATXN1; (+) strand; PAM type: NNGRRT; PAM sequence: TAGAAT
agcatgcacaaagagttcac

SEQ ID NO: 21467 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tcaacacactccatttacag

SEQ ID NO: 21468 - DNA, 20 bp, Artificial Sequence
  Description of Artificial Sequence: Synthetic oligonucleotide
  Target: ATXN1; (+) strand; PAM type: NNGRRT; PAM sequence: CAGGGT
actcaatctttgaggtctga

SEQ ID NO: 21469 - DNA, 20 bp, Artificial Sequence
  Description of Artificial Sequence: Synthetic oligonucleotide
  Target: ATXN1; (+) strand; PAM type: NNGRRT; PAM sequence: ATGAGT
atcttgattatggtaactgc

SEQ ID NO: 21470 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tacataagacacttgtttcc

SEQ ID NO: 21471 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ctagtaaaacacactgtaac

SEQ ID NO: 21472 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ataaaaaggtagtatgggct

SEQ ID NO: 21473 - DNA, 20 bp, Artificial Sequence
  Description of Artificial Sequence: Synthetic oligonucleotide
  Target: ATXN1; (+) strand; PAM type: NNGRRT; PAM sequence: GAGGAT
attttgggaagcagaggcgg

SEQ ID NO: 21474 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tactctgaaggctgaggtgg

SEQ ID NO: 21475 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cttgggaggcagaggttgca

SEQ ID NO: 21476 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcttgccattgcactccagc

SEQ ID NO: 21477 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttgcactccagcctgggtga

SEQ ID NO: 21478 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtgtacttgatctcaacagt

SEQ ID NO: 21479 - DNA, 20 bp, Artificial Sequence
  Description of Artificial Sequence: Synthetic oligonucleotide
  Target: ATXN1; (+) strand; PAM type: NNGRRT; PAM sequence: TAGGAT
cttgatctcaacagtaggaa

SEQ ID NO: 21480 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tccactagacccaacgtgta

SEQ ID NO: 21481 - DNA, 20 bp, Artificial Sequence
  Description of Artificial Sequence: Synthetic oligonucleotide
  Target: ATXN1; (+) strand; PAM type: NNGRRT; PAM sequence: TTGAAT
caatgaagcactgggaaaat

SEQ ID NO: 21482 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tttaaccctgaggagatgat

SEQ ID NO: 21483 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tgttcaaaaaagttttctgg

SEQ ID NO: 21484 - DNA, 20 bp, Artificial Sequence
  Description of Artificial Sequence: Synthetic oligonucleotide
  Target: ATXN1; (+) strand; PAM type: NNGRRT; PAM sequence: AAGAGT
acgcacacacatacataaac

SEQ ID NO: 21485 - DNA, 20 bp, Artificial Sequence
  Description of Artificial Sequence: Synthetic oligonucleotide
  Target: ATXN1; (+) strand; PAM type: NNGRRT; PAM sequence: CTGGGT
agaggtattcataggccatc

SEQ ID NO: 21486 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttcatcaactgcacatacag

SEQ ID NO: 21487 - DNA, 20 bp, Artificial Sequence
  Description of Artificial Sequence: Synthetic oligonucleotide
  Target: ATXN1; (+) strand; PAM type: NNGRRT; PAM sequence: CTGGAT
cacatacagaagaataattg

SEQ ID NO: 21488 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gattgctaatccttagcctg

SEQ ID NO: 21489 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaaggtgttcctacaatga

SEQ ID NO: 21490 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tcggttacatcaagtgattc

SEQ ID NO: 21491 - DNA, 20 bp, Artificial Sequence
  Description of Artificial Sequence: Synthetic oligonucleotide
  Target: ATXN1; (+) strand; PAM type: NNGRRT; PAM sequence: ACGAAT
acagtctcacgaccaattag

SEQ ID NO: 21492 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tctgccactgtcatatctta

SEQ ID NO: 21493 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctgttcctgagctctggagc

SEQ ID NO: 21494 - DNA, 20 bp, Artificial Sequence
  Description of Artificial Sequence: Synthetic oligonucleotide
  Target: ATXN1; (+) strand; PAM type: NNGRRT; PAM sequence: CTGAGT
cgtctgcatgccctactgtg

SEQ ID NO: 21495 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tactgtgctgagtttcagga

SEQ ID NO: 21496 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaagaataggaacagaaacg

SEQ ID NO: 21497 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aggaacagaaacgaagaatc

SEQ ID NO: 21498 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tcacgcaggaagctaggaga

SEQ ID NO: 21499 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ggtttgcagcgtttcgtgca

SEQ ID NO: 21500 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aagacaacacttacacccac

SEQ ID NO: 21501 - DNA, 20 bp, Artificial Sequence
  Description of Artificial Sequence: Synthetic oligonucleotide
  Target: ATXN1; (+) strand; PAM type: NNGRRT; PAM sequence: AAGGAT
acagcgaggccctgctggaa

SEQ ID NO: 21502 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gaggccctgctggaaaagga

SEQ ID NO: 21503 - DNA, 20 bp, Artificial Sequence
  Description of Artificial Sequence: Synthetic oligonucleotide
  Target: ATXN1; (+) strand; PAM type: NNGRRT; PAM sequence: CTGGAT
atcattaatattttccacac

SEQ ID NO: 21504 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gaacttgtattagcagcttt

SEQ ID NO: 21505 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gctttgaggatgacaagaaa

SEQ ID NO: 21506 - DNA, 20 bp, Artificial Sequence
  Description of Artificial Sequence: Synthetic oligonucleotide
  Target: ATXN1; (+) strand; PAM type: NNGRRT; PAM sequence: TAGAAT
acagaatttaagtgctacac

SEQ ID NO: 21507 - DNA, 20 bp, Artificial Sequence
  Description of Artificial Sequence: Synthetic oligonucleotide
  Target: ATXN1; (+) strand; PAM type: NNGRRT; PAM sequence: GTGGGT
acagttgtagtattagcatt

SEQ ID NO: 21508 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tctgaggaaaaaaaacaaaa

SEQ ID NO: 21509 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctttatctctaaaaaaaggc

SEQ ID NO: 21510 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atctctaaaaaaaggcaaga

SEQ ID NO: 21511 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ataataacaaatcttagatt

SEQ ID NO: 21512 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aattaaccatcactttcata

SEQ ID NO: 21513 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ccaggctctgtgttcaactg

SEQ ID NO: 21514 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gctcactgcctcaagaggga

SEQ ID NO: 21515 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ggacagaattaaataattat

SEQ ID NO: 21516 - DNA, 20 bp, Artificial Sequence
  Description of Artificial Sequence: Synthetic oligonucleotide
  Target: ATXN1; (+) strand; PAM type: NNGRRT; PAM sequence: CTGGAT
agatgcataaaatttgaaaa

SEQ ID NO: 21517 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ttgtgatttgtagtcatgat

SEQ ID NO: 21518 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gggggtacctcacttagaag

SEQ ID NO: 21519 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tttttattttgccatttcaa

SEQ ID NO: 21520 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tgagtctccttgaaaaagaa

SEQ ID NO: 21521 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tgaaaaacatctttaggacc

SEQ ID NO: 21522 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ggctcattcatgttctcccc

SEQ ID NO: 21523 - DNA, 20 bp, Artificial Sequence
  Description of Artificial Sequence: Synthetic oligonucleotide
  Target: ATXN1; (+) strand; PAM type: NNGRRT; PAM sequence: TGGAGT
attcatgttctccccatgaa

SEQ ID NO: 21524 - DNA, 20 bp, Artificial Sequence
  Description of Artificial Sequence: Synthetic oligonucleotide
  Target: ATXN1; (+) strand; PAM type: NNGRRT; PAM sequence: TTGAGT
caaatatgccaaacttctat

SEQ ID NO: 21525 - DNA, 20 bp, Artificial Sequence
  Description of Artificial Sequence: Synthetic oligonucleotide
  Target: ATXN1; (+) strand; PAM type: NNGRRT; PAM sequence: CAGAGT
atattccacattcaaagtct

SEQ ID NO: 21526 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tactgtctttttatactcca

SEQ ID NO: 21527 - DNA, 20 bp, Artificial Sequence
  Description of Artificial Sequence: Synthetic oligonucleotide
  Target: ATXN1; (+) strand; PAM type: NNGRRT; PAM sequence: CTGGAT
acagcatctagtggaagagc

SEQ ID NO: 21528 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ggacttaacccttactccaa

SEQ ID NO: 21529 - DNA, 20 bp, Artificial Sequence
  Description of Artificial Sequence: Synthetic oligonucleotide
  Target: ATXN1; (+) strand; PAM type: NNGRRT; PAM sequence: TGGAAT
attacatcttaagtcattag

SEQ ID NO: 21530 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggaaggtggcttgagctc

SEQ ID NO: 21531 - DNA, 20 bp, Artificial Sequence
  Description of Artificial Sequence: Synthetic oligonucleotide
  Target: ATXN1; (+) strand; PAM type: NNGRRT; PAM sequence: ACGAAT
gactcaaaaaaaggaaagaa

SEQ ID NO: 21532 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gaaacgaatagaaatggcta

SEQ ID NO: 21533 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tagagggtcttgttaaatca

SEQ ID NO: 21534 - DNA, 20 bp, Artificial Sequence
  Description of Artificial Sequence: Synthetic oligonucleotide
  Target: ATXN1; (+) strand; PAM type: NNGRRT; PAM sequence: TAGAAT
agaatgctaagacccatctg

SEQ ID NO: 21535 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aatttctgattcagtaggct

SEQ ID NO: 21536 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ctgattcagtaggcttgggg

SEQ ID NO: 21537 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tacagggccagagagatgct

SEQ ID NO: 21538 - DNA, 20 bp, Artificial Sequence
  Description of Artificial Sequence: Synthetic oligonucleotide
  Target: ATXN1; (+) strand; PAM type: NNGRRT; PAM sequence: TTGAGT
agagagatgctgaggatctt

SEQ ID NO: 21539 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ctgtgtgtggcctctctact

SEQ ID NO: 21540 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtggcctctctacttggagt

SEQ ID NO: 21541 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ctactggttccagatcctgc

SEQ ID NO: 21542 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tcagtcactgctattcctaa

SEQ ID NO: 21543 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttccttctcctccaaaggtc

SEQ ID NO: 21544 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tctaaatgcagtgacctttg

SEQ ID NO: 21545 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgcctgaacagcatcttttc

SEQ ID NO: 21546 - DNA, 20 bp, Artificial Sequence
  Description of Artificial Sequence: Synthetic oligonucleotide
  Target: ATXN1; (+) strand; PAM type: NNGRRT; PAM sequence: TGGGAT
cccttggctgttatctgggc

SEQ ID NO: 21547 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ccagccacagtgactggcct

SEQ ID NO: 21548 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aaagctgaaagacagaaaat

SEQ ID NO: 21549 - DNA, 20 bp, Artificial Sequence
  Description of Artificial Sequence: Synthetic oligonucleotide
  Target: ATXN1; (+) strand; PAM type: NNGRRT; PAM sequence: TTGGAT
cctgatgacagtaaagtccc

SEQ ID NO: 21550 - DNA, 20 bp, Artificial Sequence
  Description of Artificial Sequence: Synthetic oligonucleotide
  Target: ATXN1; (+) strand; PAM type: NNGRRT; PAM sequence: ACGGAT
ttagccatgccagaagttag

SEQ ID NO: 21551 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gccagaagttagacggatcc

SEQ ID NO: 21552 - DNA, 20 bp, Artificial Sequence
  Description of Artificial Sequence: Synthetic oligonucleotide
  Target: ATXN1; (+) strand; PAM type: NNGRRT; PAM sequence: CCGAGT
actcactgcaacctctgact

SEQ ID NO: 21553 - DNA, 20 bp, Artificial Sequence
  Description of Artificial Sequence: Synthetic oligonucleotide
  Target: ATXN1; (+) strand; PAM type: NNGRRT; PAM sequence: CCGAGT
aatactcctgactcagcctc

SEQ ID NO: 21554 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gactcagcctcccgagtagc

SEQ ID NO: 21555 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttcgctcttgttgcccaggc

SEQ ID NO: 21556 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aattctcctgtctcagcctc

SEQ ID NO: 21557 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tttggtatttttagtagaga

SEQ ID NO: 21558 - DNA, 20 bp, Artificial Sequence
  Description of Artificial Sequence: Synthetic oligonucleotide
  Target: ATXN1; (+) strand; PAM type: NNGRRT; PAM sequence: CGGGAT
gcctcagcctcccaaagtgc

SEQ ID NO: 21559 - DNA, 20 bp, Artificial Sequence
  Description of Artificial Sequence: Synthetic oligonucleotide
  Target: ATXN1; (+) strand; PAM type: NNGRRT; PAM sequence: TGGAAT
atggcgcccggcctgatccc

SEQ ID NO: 21560 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tcaaggttctgctgttgtga

SEQ ID NO: 21561 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ctaattaagagaaccctaaa

SEQ ID NO: 21562 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aaaagggatggggctttacc

SEQ ID NO: 21563 - DNA, 20 bp, Artificial Sequence
  Description of Artificial Sequence: Synthetic oligonucleotide
  Target: ATXN1; (+) strand; PAM type: NNGRRT; PAM sequence: GTGAAT
catatggcaaggaactgaag

SEQ ID NO: 21564 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gaaggtgaatgccaggacct

SEQ ID NO: 21565 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaataggtattgttataggt

SEQ ID NO: 21566 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tcacactctggggactgtag

SEQ ID NO: 21567 - DNA, 20 bp, Artificial Sequence
  Description of Artificial Sequence: Synthetic oligonucleotide
  Target: ATXN1; (+) strand; PAM type: NNGRRT; PAM sequence: AGGGAT
gtggggtggggggagcgggg

SEQ ID NO: 21568 - DNA, 20 bp, Artificial Sequence
  Description of Artificial Sequence: Synthetic oligonucleotide
  Target: ATXN1; (+) strand; PAM type: NNGRRT; PAM sequence: ACGAGT
gatatacctaatgctagatg

SEQ ID NO: 21569 - DNA, 20 bp, Artificial Sequence
  Description of Artificial Sequence: Synthetic oligonucleotide
  Target: ATXN1; (+) strand; PAM type: NNGRRT; PAM sequence: ATGGGT
taatgctagatgacgagtta

SEQ ID NO: 21570 - DNA, 20 bp, Artificial Sequence
  Description of Artificial Sequence: Synthetic oligonucleotide
  Target: ATXN1; (+) strand; PAM type: NNGRRT; PAM sequence: TTGAAT
acatttctttttttttttgc

SEQ ID NO: 21571 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ttttttttgcttgaatcact

SEQ ID NO: 21572 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ttctctgagatggtactttc

SEQ ID NO: 21573 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gtatctccccctacaaactc

SEQ ID NO: 21574 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ccgccccatgctagctcaga

SEQ ID NO: 21575 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gctttctctctctaaaccat

SEQ ID NO: 21576 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aaccatttgagtcatccctg

SEQ ID NO: 21577 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tggttgttttgtttttgcat

SEQ ID NO: 21578 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ataggtgtcatctccccaag

SEQ ID NO: 21579 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tgtggtaacttccgtaaagg

SEQ ID NO: 21580 - DNA, 20 bp, Artificial Sequence
  Description of Artificial Sequence: Synthetic oligonucleotide
  Target: ATXN1; (+) strand; PAM type: NNGRRT; PAM sequence: TTGAGT
cttgaagacgttatatgtct

SEQ ID NO: 21581 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tcaaatggaagaacaccctt

SEQ ID NO: 21582 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctctttgtatttcctttctg

SEQ ID NO: 21583 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gccagggctgctggcaattg

SEQ ID NO: 21584 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agagttcagaaatgcttcct

SEQ ID NO: 21585 - DNA, 20 bp, Artificial Sequence
  Description of Artificial Sequence: Synthetic oligonucleotide
  Target: ATXN1; (+) strand; PAM type: NNGRRT; PAM sequence: CAGGGT
aatgagcacactcagcccag

SEQ ID NO: 21586 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ctccagtgcagggctggact

SEQ ID NO: 21587 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gagtccagttagacctcaag

SEQ ID NO: 21588 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ccaaaactcaaggtattctg

SEQ ID NO: 21589 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gtcaacatttgatcatttat

SEQ ID NO: 21590 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ttcttacaaactggcagtcc

SEQ ID NO: 21591 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttggatacctagcatgcact

SEQ ID NO: 21592 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tattaactggtttgtgttca

SEQ ID NO: 21593 - DNA, 20 bp, Artificial Sequence
  Description of Artificial Sequence: Synthetic oligonucleotide
  Target: ATXN1; (+) strand; PAM type: NNGRRT; PAM sequence: AAGGAT
atggcttatcacataaaggt

SEQ ID NO: 21594 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gaaaagtatgtctgcatatc

SEQ ID NO: 21595 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gggccagaagacagggaggt

SEQ ID NO: 21596 - DNA, 20 bp, Artificial Sequence
  Description of Artificial Sequence: Synthetic oligonucleotide
  Target: ATXN1; (+) strand; PAM type: NNGRRT; PAM sequence: CCGAGT
aagcccagagactccacatc

SEQ ID NO: 21597 - DNA, 20 bp, Artificial Sequence
  Description of Artificial Sequence: Synthetic oligonucleotide
  Target: ATXN1; (+) strand; PAM type: NNGRRT; PAM sequence: ATGAGT
acatcccctttctggttgcc

SEQ ID NO: 21598 - DNA, 20 bp, Artificial Sequence
  Description of Artificial Sequence: Synthetic oligonucleotide
  Target: ATXN1; (+) strand; PAM type: NNGRRT; PAM sequence: GAGAGT
cacgcaccttctgcccagag

SEQ ID NO: 21599 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tctctttttgccataatatt

SEQ ID NO: 21600 - DNA, 20 bp, Artificial Sequence
  Description of Artificial Sequence: Synthetic oligonucleotide
  Target: ATXN1; (+) strand; PAM type: NNGRRT; PAM sequence: GGGAGT
acttcacaaagtaccaaacg

SEQ ID NO: 21601 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gtgaagataaaatgaagaga

SEQ ID NO: 21602 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttttgaacagacacaagtaa

SEQ ID NO: 21603 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccaaggcag

SEQ ID NO: 21604 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggtggatcatttgaggtc

SEQ ID NO: 21605 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcacgaggctgaggcag

SEQ ID NO: 21606 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcatgccactgcactctagc

SEQ ID NO: 21607 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactctagcctgggtga

SEQ ID NO: 21608 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cattcaaagctcaaaaacaa

SEQ ID NO: 21609 - DNA, 20 bp, Artificial Sequence
  Description of Artificial Sequence: Synthetic oligonucleotide
  Target: ATXN1; (+) strand; PAM type: NNGRRT; PAM sequence: CCGAGT
actccttttttaatactatt

SEQ ID NO: 21610 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aaagcattctagcttaaaac

SEQ ID NO: 21611 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ggatttcaatggtcttaact

SEQ ID NO: 21612 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tgccacttggcattatatct

SEQ ID NO: 21613 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aaagacaggtatactttgat

SEQ ID NO: 21614 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ttgatgtgggttacgcaggg

SEQ ID NO: 21615 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tacaattattctttctttct

SEQ ID NO: 21616 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agcacagatccatcgtgtgg

SEQ ID NO: 21617 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gggatggggaaacacaggag

SEQ ID NO: 21618 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ggaaacacaggagaggggtg

SEQ ID NO: 21619 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aaaatatcaactactatttt

SEQ ID NO: 21620 - DNA, 20 bp, Artificial Sequence
  Description of Artificial Sequence: Synthetic oligonucleotide
  Target: ATXN1; (+) strand; PAM type: NNGRRT; PAM sequence: AAGAGT
atgcagccgtggtttgtctt

SEQ ID NO: 21621 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gcgtttcattaaaaacccca

SEQ ID NO: 21622 - DNA, 20 bp, Artificial Sequence
  Description of Artificial Sequence: Synthetic oligonucleotide
  Target: ATXN1; (+) strand; PAM type: NNGRRT; PAM sequence: TAGAAT
actaaatatttaaaactctt

SEQ ID NO: 21623 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tccccatttctattaggaga

SEQ ID NO: 21624 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tctattaggagaaagaataa

SEQ ID NO: 21625 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ctccttcatcttgcagattt

SEQ ID NO: 21626 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tatcctagtatcatggctca

SEQ ID NO: 21627 - DNA, 20 bp, Artificial Sequence
  Description of Artificial Sequence: Synthetic oligonucleotide
  Target: ATXN1; (+) strand; PAM type: NNGRRT; PAM sequence: TCGAAT
ttcactgcttaattgttttg

SEQ ID NO: 21628 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aaattctattgctaaaacaa

SEQ ID NO: 21629 - DNA, 20 bp, Artificial Sequence
  Description of Artificial Sequence: Synthetic oligonucleotide
  Target: ATXN1; (+) strand; PAM type: NNGRRT; PAM sequence: GGGAAT
taaaacaatggaattctccc

SEQ ID NO: 21630 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tttcactctcctaagtttgc

SEQ ID NO: 21631 - DNA, 20 bp, Artificial Sequence
  Description of Artificial Sequence: Synthetic oligonucleotide
  Target: ATXN1; (+) strand; PAM type: NNGRRT; PAM sequence: ACGAGT
ccttggtgacagtgcaatgg

SEQ ID NO: 21632 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgatttctaatgtcaatcac

SEQ ID NO: 21633 - DNA, 20 bp, Artificial Sequence
  Description of Artificial Sequence: Synthetic oligonucleotide
  Target: ATXN1; (+) strand; PAM type: NNGRRT; PAM sequence: TTGAGT
agaggtgcccaagcttctgt

SEQ ID NO: 21634 - DNA, 20 bp, Artificial Sequence
  Description of Artificial Sequence: Synthetic oligonucleotide
  Target: ATXN1; (+) strand; PAM type: NNGRRT; PAM sequence: TAGAAT
agacctttccaggtcaggtg

SEQ ID NO: 21635 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tccaggtcaggtgtagaatc

SEQ ID NO: 21636 - DNA, 20 bp, Artificial Sequence
  Description of Artificial Sequence: Synthetic oligonucleotide
  Target: ATXN1; (+) strand; PAM type: NNGRRT; PAM sequence: ATGAAT
caggtgtagaatctggagtg

SEQ ID NO: 21637 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttgaacattagaggaaaaaa

SEQ ID NO: 21638 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aaaacagaataagatgaaaa

SEQ ID NO: 21639 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aagatgaaaatggaatcaca

SEQ ID NO: 21640 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctggtttaaggctatatgtg

SEQ ID NO: 21641 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gtgcaggattagagaagaga

SEQ ID NO: 21642 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tagagaagagatggggtcaa

SEQ ID NO: 21643 - DNA, 20 bp, Artificial Sequence
  Description of Artificial Sequence: Synthetic oligonucleotide
  Target: ATXN1; (+) strand; PAM type: NNGRRT; PAM sequence: AGGAGT
taatctactttctgactcta

SEQ ID NO: 21644 - DNA, 20 bp, Artificial Sequence
  Description of Artificial Sequence: Synthetic oligonucleotide
  Target: ATXN1; (+) strand; PAM type: NNGRRT; PAM sequence: CTGGAT
actctaaggagttgtctatt

SEQ ID NO: 21645 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttctggatgttgtgtataaa

SEQ ID NO: 21646 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ttcgtcagttgatggacatt

SEQ ID NO: 21647 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gattccatatttgggctact

SEQ ID NO: 21648 - DNA, 20 bp, Artificial Sequence
  Description of Artificial Sequence: Synthetic oligonucleotide
  Target: ATXN1; (+) strand; PAM type: NNGRRT; PAM sequence: TTGAAT
attcatgtacatgtttttgt

SEQ ID NO: 21649 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tatacctaagagcagaacta

SEQ ID NO: 21650 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aaaaaattatggccatcata

SEQ ID NO: 21651 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tgcctttgtccatctttaaa

SEQ ID NO: 21652 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ggttgttagtctttttctct

SEQ ID NO: 21653 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tctttttctctttgaattgt

SEQ ID NO: 21654 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gtgcttttggtgtcacatct

SEQ ID NO: 21655 - DNA, 20 bp, Artificial Sequence
  Description of Artificial Sequence: Synthetic oligonucleotide
  Target: ATXN1; (+) strand; PAM type: NNGRRT; PAM sequence: TAGGGT
atagtttcagttcctacatt

SEQ ID NO: 21656 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ttttgtatatggtgtgaggt

SEQ ID NO: 21657 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gaaaagaggtaagagagatt

SEQ ID NO: 21658 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taaagatgcagcaagttttc

SEQ ID NO: 21659 - DNA, 20 bp, Artificial Sequence
  Description of Artificial Sequence: Synthetic oligonucleotide
  Target: ATXN1; (+) strand; PAM type: NNGRRT; PAM sequence: TTGGGT
gtagcttgaaattgctgact

SEQ ID NO: 21660 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctctgtttatcttaagcaaa

SEQ ID NO: 21661 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aaagaatacagtgtaggttg

SEQ ID NO: 21662 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tcatcaattcagccaatgca

SEQ ID NO: 21663 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gatttagaaagtactaatgt

SEQ ID NO: 21664 - DNA, 20 bp, Artificial Sequence
  Description of Artificial Sequence: Synthetic oligonucleotide
  Target: ATXN1; (+) strand; PAM type: NNGRRT; PAM sequence: TGGGGT
agatccttacttaactggtc

SEQ ID NO: 21665 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ctggggtatggctcaggcaa

SEQ ID NO: 21666 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tctactatgcagccaaggtg

SEQ ID NO: 21667 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tgcaccacttgcaagcaatt

SEQ ID NO: 21668 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ccgattaaaactaacaaaac

SEQ ID NO: 21669 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tttcaaaagggccaaccact

SEQ ID NO: 21670 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tcaatgtggcacccatcttg

SEQ ID NO: 21671 - DNA, 20 bp, Artificial Sequence
  Description of Artificial Sequence: Synthetic oligonucleotide
  Target: ATXN1; (+) strand; PAM type: NNGRRT; PAM sequence: GGGGAT
catcttgtggaatgggacga

SEQ ID NO: 21672 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ggggataacaactcgctgaa

SEQ ID NO: 21673 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tttctctatattgtatgcat

SEQ ID NO: 21674 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tattgtatgcatgtgggtgt

SEQ ID NO: 21675 - DNA, 20 bp, Artificial Sequence
  Description of Artificial Sequence: Synthetic oligonucleotide
  Target: ATXN1; (+) strand; PAM type: NNGRRT; PAM sequence: AAGGGT
acctaaggaaagtggacctc

SEQ ID NO: 21676 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agtggacctcaagggtatat

SEQ ID NO: 21677 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gcccaactacaagaaggtac

SEQ ID NO: 21678 - DNA, 20 bp, Artificial Sequence
  Description of Artificial Sequence: Synthetic oligonucleotide
  Target: ATXN1; (+) strand; PAM type: NNGRRT; PAM sequence: TAGGGT
actacaagaaggtacctggg

SEQ ID NO: 21679 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aactaccaattcattcattt

SEQ ID NO: 21680 - DNA, 20 bp, Artificial Sequence
  Description of Artificial Sequence: Synthetic oligonucleotide
  Target: ATXN1; (+) strand; PAM type: NNGRRT; PAM sequence: GTGAGT
attacaaagcttaatcagta

SEQ ID NO: 21681 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agtagtgagtgacaagactg

SEQ ID NO: 21682 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gacacaatagtagaacaaat

SEQ ID NO: 21683 - DNA, 20 bp, Artificial Sequence
  Description of Artificial Sequence: Synthetic oligonucleotide
  Target: ATXN1; (+) strand; PAM type: NNGRRT; PAM sequence: GTGAGT
atgatggtagaaattgggaa

SEQ ID NO: 21684 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gtgtaggtttgtgcatgtgc

SEQ ID NO: 21685 - DNA, 20 bp, Artificial Sequence
  Description of Artificial Sequence: Synthetic oligonucleotide
  Target: ATXN1; (+) strand; PAM type: NNGRRT; PAM sequence: TTGAGT
cacacaatcacacacaaggc

SEQ ID NO: 21686 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tttccttaaaacaaggaaag

SEQ ID NO: 21687 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttatgccataaggaaactgg

SEQ ID NO: 21688 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ttaaattttactttaagttc

SEQ ID NO: 21689 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ctcattattcaactcctact

SEQ ID NO: 21690 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgttcctgtgttagtttgct

SEQ ID NO: 21691 - DNA, 20 bp, Artificial Sequence
  Description of Artificial Sequence: Synthetic oligonucleotide
  Target: ATXN1; (+) strand; PAM type: NNGRRT; PAM sequence: TTGGGT
agtctatcattgatgggcat

SEQ ID NO: 21692 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gtgtgcatgtgtctttataa

SEQ ID NO: 21693 - DNA, 20 bp, Artificial Sequence
  Description of Artificial Sequence: Synthetic oligonucleotide
  Target: ATXN1; (+) strand; PAM type: NNGRRT; PAM sequence: TTGGGT
acagaatgatttataatcct

SEQ ID NO: 21694 - DNA, 20 bp, Artificial Sequence
  Description of Artificial Sequence: Synthetic oligonucleotide
  Target: ATXN1; (+) strand; PAM type: NNGRRT; PAM sequence: CGGGAT
tttgggtatataaccagtaa

SEQ ID NO: 21695 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tataaccagtaacgggattg

SEQ ID NO: 21696 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tttctggttctagatccttg

SEQ ID NO: 21697 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agcatctattaggaaactgg

SEQ ID NO: 21698 - DNA, 20 bp, Artificial Sequence
  Description of Artificial Sequence: Synthetic oligonucleotide
  Target: ATXN1; (+) strand; PAM type: NNGRRT; PAM sequence: AGGAGT
aatagatttaggagctgcaa

SEQ ID NO: 21699 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tttaggagctgcaaaggagt

SEQ ID NO: 21700 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tgagaaaagttttcacaagt

SEQ ID NO: 21701 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ctccttgtctcctaattgta

SEQ ID NO: 21702 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aaaatcattctcagtatgct

SEQ ID NO: 21703 - DNA, 20 bp, Artificial Sequence
  Description of Artificial Sequence: Synthetic oligonucleotide
  Target: ATXN1; (+) strand; PAM type: NNGRRT; PAM sequence: TAGAAT
cttcaaccacatttcaggct

SEQ ID NO: 21704 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ttaaacaaattgaaaaacag

SEQ ID NO: 21705 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gtaaagaaacaaaacttgcc

SEQ ID NO: 21706 - DNA, 20 bp, Artificial Sequence
  Description of Artificial Sequence: Synthetic oligonucleotide
  Target: ATXN1; (+) strand; PAM type: NNGRRT; PAM sequence: CAGAAT
acaaagttcaatcctacata

SEQ ID NO: 21707 - DNA, 20 bp, Artificial Sequence
  Description of Artificial Sequence: Synthetic oligonucleotide
  Target: ATXN1; (+) strand; PAM type: NNGRRT; PAM sequence: CGGAAT
ttcaatcctacatacagaat

SEQ ID NO: 21708 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aatcgcacacaaagaaaagt

SEQ ID NO: 21709 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tatatttctacaaattcctt

SEQ ID NO: 21710 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aattcccactgaacatttca

SEQ ID NO: 21711 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gagaaagaaggtttattgct

SEQ ID NO: 21712 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aaggtttattgctttgaatg

SEQ ID NO: 21713 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gagaaatcctcaggctactg

SEQ ID NO: 21714 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gtctgacctccaccgagctg

SEQ ID NO: 21715 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tcatgacaagttaccaccaa

SEQ ID NO: 21716 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gctttcacttaaactaacct

SEQ ID NO: 21717 - DNA, 20 bp, Artificial Sequence
  Description of Artificial Sequence: Synthetic oligonucleotide
  Target: ATXN1; (+) strand; PAM type: NNGRRT; PAM sequence: TTGAAT
agtggcttcataaatatttg

SEQ ID NO: 21718 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gcttcataaatatttgttga

SEQ ID NO: 21719 - DNA, 20 bp, Artificial Sequence
  Description of Artificial Sequence: Synthetic oligonucleotide
  Target: ATXN1; (+) strand; PAM type: NNGRRT; PAM sequence: ATGAAT
cataaatatttgttgaatga

SEQ ID NO: 21720 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tgttgaatgaatgaataaag

SEQ ID NO: 21721 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gaatgaatgaataaagatgg

SEQ ID NO: 21722 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gaatgaataaagatggatgg

SEQ ID NO: 21723 - DNA, 20 bp, Artificial Sequence
  Description of Artificial Sequence: Synthetic oligonucleotide
  Target: ATXN1; (+) strand; PAM type: NNGRRT; PAM sequence: GTGGAT
gaataaagatggatgggtga

SEQ ID NO: 21724 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aaaaattcttaaaaatgtaa

SEQ ID NO: 21725 - DNA, 20 bp, Artificial Sequence
  Description of Artificial Sequence: Synthetic oligonucleotide
  Target: ATXN1; (+) strand; PAM type: NNGRRT; PAM sequence: TAGGGT
aaaaatgtaattgaatgatc

SEQ ID NO: 21726 - DNA, 20 bp, Artificial Sequence
  Description of Artificial Sequence: Synthetic oligonucleotide
  Target: ATXN1; (+) strand; PAM type: NNGRRT; PAM sequence: TGGGGT
taattgaatgatctagggtg

SEQ ID NO: 21727 - DNA, 20 bp, Artificial Sequence
  Description of Artificial Sequence: Synthetic oligonucleotide
  Target: ATXN1; (+) strand; PAM type: NNGRRT; PAM sequence: ATGAAT
agcagtttgggctgctcaaa

SEQ ID NO: 21728 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ggctgctcaaaatgaatttc

SEQ ID NO: 21729 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tatatatgattggtacataa

SEQ ID NO: 21730 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gtatctatttcatatttgca

SEQ ID NO: 21731 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aagaaggaaaaggacttgaa

SEQ ID NO: 21732 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aagggtgacaagtcactcag

SEQ ID NO: 21733 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tgacaagtcactcaggtgaa

SEQ ID NO: 21734 - DNA, 20 bp, Artificial Sequence
  Description of Artificial Sequence: Synthetic oligonucleotide
  Target: ATXN1; (+) strand; PAM type: NNGRRT; PAM sequence: CTGGAT
aggccaggaggtgaccaggc

SEQ ID NO: 21735 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ctgaccttcttacgaggctc

SEQ ID NO: 21736 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ctctacttctattttccaac

SEQ ID NO: 21737 - DNA, 20 bp, Artificial Sequence
  Description of Artificial Sequence: Synthetic oligonucleotide
  Target: ATXN1; (+) strand; PAM type: NNGRRT; PAM sequence: CTGAGT
cctccgaggaacgtaggcca

SEQ ID NO: 21738 - DNA, 20 bp, Artificial Sequence
  Description of Artificial Sequence: Synthetic oligonucleotide
  Target: ATXN1; (+) strand; PAM type: NNGRRT; PAM sequence: TTGAAT
acaggcaagcttaccatgtg

SEQ ID NO: 21739 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ggtcccttattaggtgggct

SEQ ID NO: 21740 - DNA, 20 bp, Artificial Sequence
  Description of Artificial Sequence: Synthetic oligonucleotide
  Target: ATXN1; (+) strand; PAM type: NNGRRT; PAM sequence: TAGGGT
acagtttaacgaaagcaaat

SEQ ID NO: 21741 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tttagtgttgcttcacttgc

SEQ ID NO: 21742 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tgcttcacttgccagagtaa

SEQ ID NO: 21743 - DNA, 20 bp, Artificial Sequence
  Description of Artificial Sequence: Synthetic oligonucleotide
  Target: ATXN1; (+) strand; PAM type: NNGRRT; PAM sequence: ACGAAT
taaaagcctccatataccca

SEQ ID NO: 21744 - DNA, 20 bp, Artificial Sequence
  Description of Artificial Sequence: Synthetic oligonucleotide
  Target: ATXN1; (+) strand; PAM type: NNGRRT; PAM sequence: GCGAAT
ctccatatacccaacgaatg

SEQ ID NO: 21745 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtgtcccatttcctcccata

SEQ ID NO: 21746 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gcatcagggcttactataag

SEQ ID NO: 21747 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tactataagctgagttaaac

SEQ ID NO: 21748 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ggaaaaatagaaaatatttc

SEQ ID NO: 21749 - DNA, 20 bp, Artificial Sequence
  Description of Artificial Sequence: Synthetic oligonucleotide
  Target: ATXN1; (+) strand; PAM type: NNGRRT; PAM sequence: TTGGGT
cacatgatgtgactcatcat

SEQ ID NO: 21750 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gttcatcattttattaagca

SEQ ID NO: 21751 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cacaagacagtagttcagaa

SEQ ID NO: 21752 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctccctatgtaattggtggc

SEQ ID NO: 21753 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttgaaattctctggaaaaca

SEQ ID NO: 21754 - DNA, 20 bp, Artificial Sequence
  Description of Artificial Sequence: Synthetic oligonucleotide
  Target: ATXN1; (+) strand; PAM type: NNGRRT; PAM sequence: ATGAAT
acacagaatccatttacatg

SEQ ID NO: 21755 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gtcttgttcagaagtgttag

SEQ ID NO: 21756 - DNA, 20 bp, Artificial Sequence
  Description of Artificial Sequence: Synthetic oligonucleotide
  Target: ATXN1; (+) strand; PAM type: NNGRRT; PAM sequence: ATGAGT
cagaagtgttaggagaattg

SEQ ID NO: 21757 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ctaattctcttctaccctaa

SEQ ID NO: 21758 - DNA, 20 bp, Artificial Sequence
  Description of Artificial Sequence: Synthetic oligonucleotide
  Target: ATXN1; (+) strand; PAM type: NNGRRT; PAM sequence: ATGAGT
acatcattcaacgccatgta

SEQ ID NO: 21759 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gacaccactgaaataaacca

SEQ ID NO: 21760 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tgaaataaaccaaaggatgt

SEQ ID NO: 21761 - DNA, 20 bp, Artificial Sequence
  Description of Artificial Sequence: Synthetic oligonucleotide
  Target: ATXN1; (+) strand; PAM type: NNGRRT; PAM sequence: CTGGAT
atgtagggatgtatgtacag

SEQ ID NO: 21762 - DNA, 20 bp, Artificial Sequence
  Description of Artificial Sequence: Synthetic oligonucleotide
  Target: ATXN1; (+) strand; PAM type: NNGRRT; PAM sequence: ATGGAT
agggatgtatgtacagctgg

SEQ ID NO: 21763 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atgtatgtacagctggatgg

SEQ ID NO: 21764 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ctggatggatgaatggacag

SEQ ID NO: 21765 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatgaatggacagatgg

SEQ ID NO: 21766 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gatcatcatgctttaagcct

SEQ ID NO: 21767 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gctttaagccttagaatatg

SEQ ID NO: 21768 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tttggttaggaacttttaat

SEQ ID NO: 21769 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atagaaggtgtttgaagtta

SEQ ID NO: 21770 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tgaagttaatgaataaataa

SEQ ID NO: 21771 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ataaataaatggataaatag

SEQ ID NO: 21772 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cctctaggaaagactgacct

SEQ ID NO: 21773 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tttacaattattatgtatgc

SEQ ID NO: 21774 - DNA, 20 bp, Artificial Sequence
  Description of Artificial Sequence: Synthetic oligonucleotide
  Target: ATXN1; (+) strand; PAM type: NNGRRT; PAM sequence: TTGAGT
agcctaagtacccttaattt

SEQ ID NO: 21775 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gactttcctagttgcaagca

SEQ ID NO: 21776 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cacagtaagtggttaagttg

SEQ ID NO: 21777 - DNA, 20 bp, Artificial Sequence
  Description of Artificial Sequence: Synthetic oligonucleotide
  Target: ATXN1; (+) strand; PAM type: NNGRRT; PAM sequence: AAGAAT
catcaaaatacactcacagg

SEQ ID NO: 21778 - DNA, 20 bp, Artificial Sequence
  Description of Artificial Sequence: Synthetic oligonucleotide
  Target: ATXN1; (+) strand; PAM type: NNGRRT; PAM sequence: TAGGAT
catctcttaataatatggtt

SEQ ID NO: 21779 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gacaataatggtccccaatg

SEQ ID NO: 21780 - DNA, 20 bp, Artificial Sequence
  Description of Artificial Sequence: Synthetic oligonucleotide
  Target: ATXN1; (+) strand; PAM type: NNGRRT; PAM sequence: TGGGGT
atatgtctttttttggccaa

SEQ ID NO: 21781 - DNA, 20 bp, Artificial Sequence
  Description of Artificial Sequence: Synthetic oligonucleotide
  Target: ATXN1; (+) strand; PAM type: NNGRRT; PAM sequence: ACGAAT
ggtctcaacaaatgtaacca

SEQ ID NO: 21782 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caaatgtaaccaacgaatat

SEQ ID NO: 21783 - DNA, 20 bp, Artificial Sequence
  Description of Artificial Sequence: Synthetic oligonucleotide
  Target: ATXN1; (+) strand; PAM type: NNGRRT; PAM sequence: TAGGAT
aggaatgggcacttgcggct

SEQ ID NO: 21784 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tctggtaatagcatcaaaca

SEQ ID NO: 21785 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ctggccaaaaaattcattga

SEQ ID NO: 21786 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aaaaattcattgaaaggata

SEQ ID NO: 21787 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gtctcaaacctccaacctat

SEQ ID NO: 21788 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gttcataaaaaatttaaaaa

SEQ ID NO: 21789 - DNA, 20 bp, Artificial Sequence
  Description of Artificial Sequence: Synthetic oligonucleotide
  Target: ATXN1; (+) strand; PAM type: NNGRRT; PAM sequence: ATGAAT
acccaagtgtttatggacag

SEQ ID NO: 21790 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aagtgtttatggacagatga

SEQ ID NO: 21791 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aaacaaaatgtgatatatac

SEQ ID NO: 21792 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aaatgtgatatatacaagag

SEQ ID NO: 21793 - DNA, 20 bp, Artificial Sequence
  Description of Artificial Sequence: Synthetic oligonucleotide
  Target: ATXN1; (+) strand; PAM type: NNGRRT; PAM sequence: ATGGAT
attctgacacatgttacaac

SEQ ID NO: 21794 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aaattcatagaggcagaaag

SEQ ID NO: 21795 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gggagggggaagggggaagg

SEQ ID NO: 21796 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aagggggaatttattgtcta

SEQ ID NO: 21797 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aatttattgtctaatgggta

SEQ ID NO: 21798 - DNA, 20 bp, Artificial Sequence
  Description of Artificial Sequence: Synthetic oligonucleotide
  Target: ATXN1; (+) strand; PAM type: NNGRRT; PAM sequence: CTGGAT
caagacacaaacagctgaga

SEQ ID NO: 21799 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gctgagactggatgcacaac

SEQ ID NO: 21800 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ggatgcacaacgagaatata

SEQ ID NO: 21801 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gtgtcatgaaaatagcaaag

SEQ ID NO: 21802 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gaccggcatactatgttaga

SEQ ID NO: 21803 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tctctattttccccattgct

SEQ ID NO: 21804 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ctatctactactccttctct

SEQ ID NO: 21805 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atcctacatatacatgccag

SEQ ID NO: 21806 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgctggttcctcttcgcttc

SEQ ID NO: 21807 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttcgcttcctgaattaagtc

SEQ ID NO: 21808 - DNA, 20 bp, Artificial Sequence
  Description of Artificial Sequence: Synthetic oligonucleotide
  Target: ATXN1; (+) strand; PAM type: NNGRRT; PAM sequence: ACGGGT
cttttccccatcacaggcat

SEQ ID NO: 21809 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agaacgtactcttcactttc

SEQ ID NO: 21810 - DNA, 20 bp, Artificial Sequence
  Description of Artificial Sequence: Synthetic oligonucleotide
  Target: ATXN1; (+) strand; PAM type: NNGRRT; PAM sequence: TAGGAT
cctagttccttttcagatca

SEQ ID NO: 21811 - DNA, 20 bp, Artificial Sequence
  Description of Artificial Sequence: Synthetic oligonucleotide
  Target: ATXN1; (+) strand; PAM type: NNGRRT; PAM sequence: CAGGAT
caggccctatctcagaccga

SEQ ID NO: 21812 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gcattttaacaatattccca

SEQ ID NO: 21813 - DNA, 20 bp, Artificial Sequence
  Description of Artificial Sequence: Synthetic oligonucleotide
  Target: ATXN1; (+) strand; PAM type: NNGRRT; PAM sequence: GTGAGT
taactcattcaaagatcatt

SEQ ID NO: 21814 - DNA, 20 bp, Artificial Sequence
  Description of Artificial Sequence: Synthetic oligonucleotide
  Target: ATXN1; (+) strand; PAM type: NNGRRT; PAM sequence: GAGAAT
actgtgggaggcagaggtgg

SEQ ID NO: 21815 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ggcagaggtgggagaatcac

SEQ ID NO: 21816 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggagaatcacttgagtcc

SEQ ID NO: 21817 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ggttgaggctgcaatgagct

SEQ ID NO: 21818 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gtgcaccactgcactccagc

SEQ ID NO: 21819 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactccagcctgggtga

SEQ ID NO: 21820 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tttataaagcttgtctattt

SEQ ID NO: 21821 - DNA, 20 bp, Artificial Sequence
  Description of Artificial Sequence: Synthetic oligonucleotide
  Target: ATXN1; (+) strand; PAM type: NNGRRT; PAM sequence: AAGAGT
atatgtgcatcaaagtttta

SEQ ID NO: 21822 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttttttttcccacgtggtag

SEQ ID NO: 21823 - DNA, 20 bp, Artificial Sequence
  Description of Artificial Sequence: Synthetic oligonucleotide
  Target: ATXN1; (+) strand; PAM type: NNGRRT; PAM sequence: GTGGGT
acatactcaactactgtaaa

SEQ ID NO: 21824 - DNA, 20 bp, Artificial Sequence
  Description of Artificial Sequence: Synthetic oligonucleotide
  Target: ATXN1; (+) strand; PAM type: NNGRRT; PAM sequence: AGGGGT
taatttagttagggagagga

SEQ ID NO: 21825 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ccactagagggcattaacat

SEQ ID NO: 21826 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aataaaatcatcctgatttc

SEQ ID NO: 21827 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaacagcagacaccatgcat

SEQ ID NO: 21828 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ttaacacaatagacatttaa

SEQ ID NO: 21829 - DNA, 20 bp, Artificial Sequence
  Description of Artificial Sequence: Synthetic oligonucleotide
  Target: ATXN1; (+) strand; PAM type: NNGRRT; PAM sequence: TAGGAT
agccatgctagctccaggac

SEQ ID NO: 21830 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ggattgacatatgtttcctt

SEQ ID NO: 21831 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cttcagaagtccacaacctt

SEQ ID NO: 21832 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aacagaggtcttttctccct

SEQ ID NO: 21833 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actttgggaagccaaagtga

SEQ ID NO: 21834 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tgagaggattgcttgagccc

SEQ ID NO: 21835 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tgatagtccacccattgcaa

SEQ ID NO: 21836 - DNA, 20 bp, Artificial Sequence
  Description of Artificial Sequence: Synthetic oligonucleotide
  Target: ATXN1; (+) strand; PAM type: NNGRRT; PAM sequence: GAGAAT
caacagtcctcagttctgag

SEQ ID NO: 21837 - DNA, 20 bp, Artificial Sequence
  Description of Artificial Sequence: Synthetic oligonucleotide
  Target: ATXN1; (+) strand; PAM type: NNGRRT; PAM sequence: GTGGGT
caggccaccgccctgcctta

SEQ ID NO: 21838 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tctaatctttgtacatactc

SEQ ID NO: 21839 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tcatgggttcaattaccagg

SEQ ID NO: 21840 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tccccgcctccattcagcgt

SEQ ID NO: 21841 - DNA, 20 bp, Artificial Sequence
  Description of Artificial Sequence: Synthetic oligonucleotide
  Target: ATXN1; (+) strand; PAM type: NNGRRT; PAM sequence: TTGAGT
cctcagaaagcaccatttgt

SEQ ID NO: 21842 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gctctaatgttttggagcta

SEQ ID NO: 21843 - DNA, 20 bp, Artificial Sequence
  Description of Artificial Sequence: Synthetic oligonucleotide
  Target: ATXN1; (+) strand; PAM type: NNGRRT; PAM sequence: CTGAAT
atcacagaaccaggaaatag

SEQ ID NO: 21844 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aatcacccctcagctctaag

SEQ ID NO: 21845 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ggttaaaaagtgaagagaaa

SEQ ID NO: 21846 - DNA, 20 bp, Artificial Sequence
  Description of Artificial Sequence: Synthetic oligonucleotide
  Target: ATXN1; (+) strand; PAM type: NNGRRT; PAM sequence: GAGGGT
attccctccctcctgcaagt

SEQ ID NO: 21847 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gccaggagctacagcaacag

SEQ ID NO: 21848 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gtactttaaaagagagacag

SEQ ID NO: 21849 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gacaacaagcagcactttct

SEQ ID NO: 21850 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tattatttagtaagatgtgg

SEQ ID NO: 21851 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gatgtggttgagtggcccct

SEQ ID NO: 21852 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aggaaaatgtttggggcacg

SEQ ID NO: 21853 - DNA, 20 bp, Artificial Sequence
  Description of Artificial Sequence: Synthetic oligonucleotide
  Target: ATXN1; (+) strand; PAM type: NNGRRT; PAM sequence: CTGAGT
atgtatgcatttttcagctc

SEQ ID NO: 21854 - DNA, 20 bp, Artificial Sequence
  Description of Artificial Sequence: Synthetic oligonucleotide
  Target: ATXN1; (+) strand; PAM type: NNGRRT; PAM sequence: TTGAGT
actctgaagcctgctcgtgc

SEQ ID NO: 21855 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttctacacaaagtacatcaa

SEQ ID NO: 21856 - DNA, 20 bp, Artificial Sequence
  Description of Artificial Sequence: Synthetic oligonucleotide
  Target: ATXN1; (+) strand; PAM type: NNGRRT; PAM sequence: AGGAAT
cgatcatcttgctatttgca

SEQ ID NO: 21857 - DNA, 20 bp, Artificial Sequence
  Description of Artificial Sequence: Synthetic oligonucleotide
  Target: ATXN1; (+) strand; PAM type: NNGRRT; PAM sequence: GGGGAT
acaggccacggtgatattat

SEQ ID NO: 21858 - DNA, 20 bp, Artificial Sequence
  Description of Artificial Sequence: Synthetic oligonucleotide
  Target: ATXN1; (+) strand; PAM type: NNGRRT; PAM sequence: TGGGGT
cacgtgtcttccaagccaag

SEQ ID NO: 21859 - DNA, 20 bp, Artificial Sequence
  Description of Artificial Sequence: Synthetic oligonucleotide
  Target: ATXN1; (+) strand; PAM type: NNGRRT; PAM sequence: CAGAGT
caactcaggtgtctgtccac

SEQ ID NO: 21860 - DNA, 20 bp, Artificial Sequence
  Description of Artificial Sequence: Synthetic oligonucleotide
  Target: ATXN1; (+) strand; PAM type: NNGRRT; PAM sequence: AAGGGT
agcaggaggttctgaccagc

SEQ ID NO: 21861 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gacaagaaaggcaagatgtc

SEQ ID NO: 21862 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gatttggggctgaggcacct

SEQ ID NO: 21863 - DNA, 20 bp, Artificial Sequence
  Description of Artificial Sequence: Synthetic oligonucleotide
  Target: ATXN1; (+) strand; PAM type: NNGRRT; PAM sequence: AAGAGT
actctgattccttggagctg

SEQ ID NO: 21864 - DNA, 20 bp, Artificial Sequence
  Description of Artificial Sequence: Synthetic oligonucleotide
  Target: ATXN1; (+) strand; PAM type: NNGRRT; PAM sequence: AAGAGT
actagagccaggcagctatg

SEQ ID NO: 21865 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ccagccccagaaagcaaaac

SEQ ID NO: 21866 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tcaaaactgactccctcttg

SEQ ID NO: 21867 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaaaagactgtcagcttgc

SEQ ID NO: 21868 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gcaggagagagacagttctc

SEQ ID NO: 21869 - DNA, 20 bp, Artificial Sequence
  Description of Artificial Sequence: Synthetic oligonucleotide
  Target: ATXN1; (+) strand; PAM type: NNGRRT; PAM sequence: GTGGAT
gagagagacagttctcatgg

SEQ ID NO: 21870 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ttttatctccactagagggc

SEQ ID NO: 21871 - DNA, 20 bp, Artificial Sequence
  Description of Artificial Sequence: Synthetic oligonucleotide
  Target: ATXN1; (+) strand; PAM type: NNGRRT; PAM sequence: TGGGGT
agggctcgaaggaagggagg

SEQ ID NO: 21872 - DNA, 20 bp, Artificial Sequence
  Description of Artificial Sequence: Synthetic oligonucleotide
  Target: ATXN1; (+) strand; PAM type: NNGRRT; PAM sequence: CTGGGT
agatactcacgtgggcatat

SEQ ID NO: 21873 - DNA, 20 bp, Artificial Sequence
  Description of Artificial Sequence: Synthetic oligonucleotide
  Target: ATXN1; (+) strand; PAM type: NNGRRT; PAM sequence: CTGGGT
atctgggtcccaggcaatcc

SEQ ID NO: 21874 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gccacaggctctctatctca

SEQ ID NO: 21875 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tacttgggaggctgaggcag

SEQ ID NO: 21876 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tagccacctaggctcaaaaa

SEQ ID NO: 21877 - DNA, 20 bp, Artificial Sequence
  Description of Artificial Sequence: Synthetic oligonucleotide
  Target: ATXN1; (+) strand; PAM type: NNGRRT; PAM sequence: CGGGAT
cttttttctccaccatctca

SEQ ID NO: 21878 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aacaagaagcaccgtgtcct

SEQ ID NO: 21879 - DNA, 20 bp, Artificial Sequence
  Description of Artificial Sequence: Synthetic oligonucleotide
  Target: ATXN1; (+) strand; PAM type: NNGRRT; PAM sequence: GCGAAT
caccacataatacacacgta

SEQ ID NO: 21880 - DNA, 20 bp, Artificial Sequence
  Description of Artificial Sequence: Synthetic oligonucleotide
  Target: ATXN1; (+) strand; PAM type: NNGRRT; PAM sequence: AGGGGT
acacgtagcgaatgtggttg

SEQ ID NO: 21881 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tgagctgtccattctccgtg

SEQ ID NO: 21882 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ccctcttcgttgatctggag

SEQ ID NO: 21883 - DNA, 20 bp, Artificial Sequence
  Description of Artificial Sequence: Synthetic oligonucleotide
  Target: ATXN1; (+) strand; PAM type: NNGRRT; PAM sequence: GCGGAT
aagatgaaagcatgagagaa

SEQ ID NO: 21884 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gagagaagcggatgcaggag

SEQ ID NO: 21885 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gatgcaggagggggatggta

SEQ ID NO: 21886 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tatagggtggtccatacacc

SEQ ID NO: 21887 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ggtggtccatacacctggga

SEQ ID NO: 21888 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gaccagatgacttgtgaact

SEQ ID NO: 21889 - DNA, 20 bp, Artificial Sequence
  Description of Artificial Sequence: Synthetic oligonucleotide
  Target: ATXN1; (+) strand; PAM type: NNGRRT; PAM sequence: TTGAGT
aagtttagccacctgctaaa

SEQ ID NO: 21890 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tgtgagaggactgggacgtt

SEQ ID NO: 21891 - DNA, 20 bp, Artificial Sequence
  Description of Artificial Sequence: Synthetic oligonucleotide
  Target: ATXN1; (+) strand; PAM type: NNGRRT; PAM sequence: TTGAAT
taggccaaagctttgaagca

SEQ ID NO: 21892 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tgaaagaggcccctagatgg

SEQ ID NO: 21893 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gatcaaagcagactgcatca

SEQ ID NO: 21894 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gcatccacagcggtcactgt

SEQ ID NO: 21895 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ttgctaagctactgaaagtt

SEQ ID NO: 21896 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tctattattaccatttggta

SEQ ID NO: 21897 - DNA, 20 bp, Artificial Sequence
  Description of Artificial Sequence: Synthetic oligonucleotide
  Target: ATXN1; (+) strand; PAM type: NNGRRT; PAM sequence: ATGGAT
accaataccaccatgcaggc

SEQ ID NO: 21898 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ccatgcaggcatggatcatc

SEQ ID NO: 21899 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aaggcattagctattcatct

SEQ ID NO: 21900 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gtagcagagaaaaaaagcta

SEQ ID NO: 21901 - DNA, 20 bp, Artificial Sequence
  Description of Artificial Sequence: Synthetic oligonucleotide
  Target: ATXN1; (+) strand; PAM type: NNGRRT; PAM sequence: ACGAGT
ccagtttcctttcccacaaa

SEQ ID NO: 21902 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gtatcttgtaaggttgttgt

SEQ ID NO: 21903 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ctgggcatgttgtaagtgct

SEQ ID NO: 21904 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atggcagatattagaggaac

SEQ ID NO: 21905 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tcaagcatttgcaatctagt

SEQ ID NO: 21906 - DNA, 20 bp, Artificial Sequence
  Description of Artificial Sequence: Synthetic oligonucleotide
  Target: ATXN1; (+) strand; PAM type: NNGRRT; PAM sequence: AAGGAT
atacaaatacatatgcacaa

SEQ ID NO: 21907 - DNA, 20 bp, Artificial Sequence
  Description of Artificial Sequence: Synthetic oligonucleotide
  Target: ATXN1; (+) strand; PAM type: NNGRRT; PAM sequence: AGGGAT
gccagacaagacagggcacc

SEQ ID NO: 21908 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cagggatgtccaggtaatta

SEQ ID NO: 21909 - DNA, 20 bp, Artificial Sequence
  Description of Artificial Sequence: Synthetic oligonucleotide
  Target: ATXN1; (+) strand; PAM type: NNGRRT; PAM sequence: TGGGAT
cttggcacagttttaaatac

SEQ ID NO: 21910 - DNA, 20 bp, Artificial Sequence
  Description of Artificial Sequence: Synthetic oligonucleotide
  Target: ATXN1; (+) strand; PAM type: NNGRRT; PAM sequence: TCGGAT
gactaacaataaaccagcag

SEQ ID NO: 21911 - DNA, 20 bp, Artificial Sequence
  Description of Artificial Sequence: Synthetic oligonucleotide
  Target: ATXN1; (+) strand; PAM type: NNGRRT; PAM sequence: TTGAGT
aaaacaacaggtaagaaggc

SEQ ID NO: 21912 - DNA, 20 bp, Artificial Sequence
  Description of Artificial Sequence: Synthetic oligonucleotide
  Target: ATXN1; (+) strand; PAM type: NNGRRT; PAM sequence: GCGGGT
aaggcttgagtgagctgggg

SEQ ID NO: 21913 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ctgggggcgggtaggcctga

SEQ ID NO: 21914 - DNA, 20 bp, Artificial Sequence
  Description of Artificial Sequence: Synthetic oligonucleotide
  Target: ATXN1; (+) strand; PAM type: NNGRRT; PAM sequence: GAGGAT
caccccagctttctatgggg

SEQ ID NO: 21915 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gctccaaccttttcttcccc

SEQ ID NO: 21916 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ccttttcttccccaagggtg

SEQ ID NO: 21917 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ttcttccccaagggtgtgga

SEQ ID NO: 21918 - DNA, 20 bp, Artificial Sequence
  Description of Artificial Sequence: Synthetic oligonucleotide
  Target: ATXN1; (+) strand; PAM type: NNGRRT; PAM sequence: TTGGAT
acgtggcctatgccccctcc

SEQ ID NO: 21919 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gcctatgccccctccttgga

SEQ ID NO: 21920 - DNA, 20 bp, Artificial Sequence
  Description of Artificial Sequence: Synthetic oligonucleotide
  Target: ATXN1; (+) strand; PAM type: NNGRRT; PAM sequence: GTGAAT
atgccccctccttggatagg

SEQ ID NO: 21921 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tgaatctatataattttgag

SEQ ID NO: 21922 - DNA, 20 bp, Artificial Sequence
  Description of Artificial Sequence: Synthetic oligonucleotide
  Target: ATXN1; (+) strand; PAM type: NNGRRT; PAM sequence: AGGGAT
taattttgagcagggttagc

SEQ ID NO: 21923 - DNA, 20 bp, Artificial Sequence
  Description of Artificial Sequence: Synthetic oligonucleotide
  Target: ATXN1; (+) strand; PAM type: NNGRRT; PAM sequence: AGGAAT
acagacctcaaaaccaaatt

SEQ ID NO: 21924 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ccaaagacaaattcaataca

SEQ ID NO: 21925 - DNA, 20 bp, Artificial Sequence
  Description of Artificial Sequence: Synthetic oligonucleotide
  Target: ATXN1; (+) strand; PAM type: NNGRRT; PAM sequence: GGGAGT
aattcaatacagtgaatatt

SEQ ID NO: 21926 - DNA, 20 bp, Artificial Sequence
  Description of Artificial Sequence: Synthetic oligonucleotide
  Target: ATXN1; (+) strand; PAM type: NNGRRT; PAM sequence: AAGGAT
attgggagtgaggtgggaaa

SEQ ID NO: 21927 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ttggtgccagtataaaaccc

SEQ ID NO: 21928 - DNA, 20 bp, Artificial Sequence
  Description of Artificial Sequence: Synthetic oligonucleotide
  Target: ATXN1; (+) strand; PAM type: NNGRRT; PAM sequence: TTGAGT
cacattaggaaaataatttc

SEQ ID NO: 21929 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ctcacaatttccttgggaga

SEQ ID NO: 21930 - DNA, 20 bp, Artificial Sequence
  Description of Artificial Sequence: Synthetic oligonucleotide
  Target: ATXN1; (+) strand; PAM type: NNGRRT; PAM sequence: GAGAAT
atttccttgggagatggagt

SEQ ID NO: 21931 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aaatacaagagcaatgtcaa

SEQ ID NO: 21932 - DNA, 20 bp, Artificial Sequence
  Description of Artificial Sequence: Synthetic oligonucleotide
  Target: ATXN1; (+) strand; PAM type: NNGRRT; PAM sequence: AGGAGT
aagatttttaaaaatgcttc

SEQ ID NO: 21933 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aaaaagtatccgttggaact

SEQ ID NO: 21934 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gttcttacaattctttcatc

SEQ ID NO: 21935 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gagctcccagaagatgagaa

SEQ ID NO: 21936 - DNA, 20 bp, Artificial Sequence
  Description of Artificial Sequence: Synthetic oligonucleotide
  Target: ATXN1; (+) strand; PAM type: NNGRRT; PAM sequence: CTGGAT
taaatgagcactctgtttcc

SEQ ID NO: 21937 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gccgctgtgccacacacagg

SEQ ID NO: 21938 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aggaggcaagtgttaatagc

SEQ ID NO: 21939 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ccaggaggggaaaggcaaga

SEQ ID NO: 21940 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ggataaggtgggaaataaaa

SEQ ID NO: 21941 - DNA, 20 bp, Artificial Sequence
  Description of Artificial Sequence: Synthetic oligonucleotide
  Target: ATXN1; (+) strand; PAM type: NNGRRT; PAM sequence: CAGGAT
agggctgccctcatcctgcc

SEQ ID NO: 21942 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gcgctggcaagagcatttcc

SEQ ID NO: 21943 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ttaaagagataccattgatg

SEQ ID NO: 21944 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aaattacggcttgtaatatt

SEQ ID NO: 21945 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gataataatttgatgccctc

SEQ ID NO: 21946 - DNA, 20 bp, Artificial Sequence
  Description of Artificial Sequence: Synthetic oligonucleotide
  Target: ATXN1; (+) strand; PAM type: NNGRRT; PAM sequence: ATGGGT
agtagccacaagtggtctac

SEQ ID NO: 21947 - DNA, 20 bp, Artificial Sequence
  Description of Artificial Sequence: Synthetic oligonucleotide
  Target: ATXN1; (+) strand; PAM type: NNGRRT; PAM sequence: AAGAAT
accagtttattctttaccca

SEQ ID NO: 21948 - DNA, 20 bp, Artificial Sequence
  Description of Artificial Sequence: Synthetic oligonucleotide
  Target: ATXN1; (+) strand; PAM type: NNGRRT; PAM sequence: GAGAAT
attgtactgtggtgtgctct

SEQ ID NO: 21949 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tggaaaccttcacagttcta

SEQ ID NO: 21950 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tggacaggagcgatcaatgt

SEQ ID NO: 21951 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aaagtgattaagctgacaag

SEQ ID NO: 21952 - DNA, 20 bp, Artificial Sequence
  Description of Artificial Sequence: Synthetic oligonucleotide
  Target: ATXN1; (+) strand; PAM type: NNGRRT; PAM sequence: TAGGAT
atttgaagccagatttaacc

SEQ ID NO: 21953 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acacagtcaagtttaccttc

SEQ ID NO: 21954 - DNA, 20 bp, Artificial Sequence
  Description of Artificial Sequence: Synthetic oligonucleotide
  Target: ATXN1; (+) strand; PAM type: NNGRRT; PAM sequence: GAGAAT
taccttctgggattctaact

SEQ ID NO: 21955 - DNA, 20 bp, Artificial Sequence
  Description of Artificial Sequence: Synthetic oligonucleotide
  Target: ATXN1; (+) strand; PAM type: NNGRRT; PAM sequence: ACGAAT
ccaacataactttaaaaaaa

SEQ ID NO: 21956 - DNA, 20 bp, Artificial Sequence
  Description of Artificial Sequence: Synthetic oligonucleotide
  Target: ATXN1; (+) strand; PAM type: NNGRRT; PAM sequence: GCGGAT
cagcactttgggaggccgag

SEQ ID NO: 21957 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcag

SEQ ID NO: 21958 - DNA, 20 bp, Artificial Sequence
  Description of Artificial Sequence: Synthetic oligonucleotide
  Target: ATXN1; (+) strand; PAM type: NNGRRT; PAM sequence: AAGAAT
taaataaacaaataaaataa

SEQ ID NO: 21959 - DNA, 20 bp, Artificial Sequence
  Description of Artificial Sequence: Synthetic oligonucleotide
  Target: ATXN1; (+) strand; PAM type: NNGRRT; PAM sequence: GCGAGT
ttctgcaggtgcagacaacc

SEQ ID NO: 21960 - DNA, 20 bp, Artificial Sequence
  Description of Artificial Sequence: Synthetic oligonucleotide
  Target: ATXN1; (+) strand; PAM type: NNGRRT; PAM sequence: TCGGGT
caggtgcagacaaccgcgag

SEQ ID NO: 21961 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gacaaccgcgagtcgggtgt

SEQ ID NO: 21962 - DNA, 20 bp, Artificial Sequence
  Description of Artificial Sequence: Synthetic oligonucleotide
  Target: ATXN1; (+) strand; PAM type: NNGRRT; PAM sequence: CTGGGT
acatccataacagaagtgtt

SEQ ID NO: 21963 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ccctttacttagtagccaac

SEQ ID NO: 21964 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tcagtcttgacccttgcctt

SEQ ID NO: 21965 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tataactctacagcctcaaa

SEQ ID NO: 21966 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tatcctgttattcttggtca

SEQ ID NO: 21967 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gacatcacagtcacttgaaa

SEQ ID NO: 21968 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ccaaaggacccagtgatgag

SEQ ID NO: 21969 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cccagtgatgaggagagtca

SEQ ID NO: 21970 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ttccaagcaggagaaaacta

SEQ ID NO: 21971 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ttcttggtgcatcatagtaa

SEQ ID NO: 21972 - DNA, 20 bp, Artificial Sequence
  Description of Artificial Sequence: Synthetic oligonucleotide
  Target: ATXN1; (+) strand; PAM type: NNGRRT; PAM sequence: GTGGGT
taattggataatattttgat

SEQ ID NO: 21973 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aaaaatacatgaaagattca

SEQ ID NO: 21974 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gtctaatttctttggaaaac

SEQ ID NO: 21975 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gtgattatttggctgactat

SEQ ID NO: 21976 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gatgtatggtccttgtgaca

SEQ ID NO: 21977 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aagtaatgtttctgtagaga

SEQ ID NO: 21978 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcagcctcccaaagtgt

SEQ ID NO: 21979 - DNA, 20 bp, Artificial Sequence
  Description of Artificial Sequence: Synthetic oligonucleotide
  Target: ATXN1; (+) strand; PAM type: NNGRRT; PAM sequence: TAGGGT
cgtgttttatttttttgaga

SEQ ID NO: 21980 - DNA, 20 bp, Artificial Sequence
  Description of Artificial Sequence: Synthetic oligonucleotide
  Target: ATXN1; (+) strand; PAM type: NNGRRT; PAM sequence: CCGGGT
atagggtcttgctttgttac

SEQ ID NO: 21981 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ttgctcacgtgcacatggct

SEQ ID NO: 21982 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcagagctgagctcagaccc

SEQ ID NO: 21983 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ctccaaagtccctctcatgg

SEQ ID NO: 21984 - DNA, 20 bp, Artificial Sequence
  Description of Artificial Sequence: Synthetic oligonucleotide
  Target: ATXN1; (+) strand; PAM type: NNGRRT; PAM sequence: GTGGAT
catgggggaattcagtgacc

SEQ ID NO: 21985 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ggaattcagtgaccgtggat

SEQ ID NO: 21986 - DNA, 20 bp, Artificial Sequence
  Description of Artificial Sequence: Synthetic oligonucleotide
  Target: ATXN1; (+) strand; PAM type: NNGRRT; PAM sequence: CTGGAT
acaggcatgtgccaccacac

SEQ ID NO: 21987 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tttttctttatttgcggaga

SEQ ID NO: 21988 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gtatgtaattaggctcatat

SEQ ID NO: 21989 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gaggccacatatcaggctga

SEQ ID NO: 21990 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tgggaaagaacagagatgat

SEQ ID NO: 21991 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tgttctgtgggcaagtttcc

SEQ ID NO: 21992 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tcccaggattccagcatctt

SEQ ID NO: 21993 - DNA, 20 bp, Artificial Sequence
  Description of Artificial Sequence: Synthetic oligonucleotide
  Target: ATXN1; (+) strand; PAM type: NNGRRT; PAM sequence: CAGGAT
catgtggccggccaccaggg

SEQ ID NO: 21994 - DNA, 20 bp, Artificial Sequence
  Description of Artificial Sequence: Synthetic oligonucleotide
  Target: ATXN1; (+) strand; PAM type: NNGRRT; PAM sequence: CAGGAT
agggcaggatagagcttttt

SEQ ID NO: 21995 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gattcccagactcagttcct

SEQ ID NO: 21996 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ggtagatactggcaaaatct

SEQ ID NO: 21997 - DNA, 20 bp, Artificial Sequence
  Description of Artificial Sequence: Synthetic oligonucleotide
  Target: ATXN1; (+) strand; PAM type: NNGRRT; PAM sequence: ACGAAT
acagacgagacgtctacagt

SEQ ID NO: 21998 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gacctcagtctgagcctcag

SEQ ID NO: 21999 - DNA, 20 bp, Artificial Sequence
  Description of Artificial Sequence: Synthetic oligonucleotide
  Target: ATXN1; (+) strand; PAM type: NNGRRT; PAM sequence: TAGAAT
caataacaatatcgacttca

SEQ ID NO: 22000 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cgcttggtacacagaagaga

SEQ ID NO: 22001 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttggtgacttaataatttgc

SEQ ID NO: 22002 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccaagccag

SEQ ID NO: 22003 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggtggatcacctgaagtc

SEQ ID NO: 22004 - DNA, 20 bp, Artificial Sequence
  Description of Artificial Sequence: Synthetic oligonucleotide
  Target: ATXN1; (+) strand; PAM type: NNGRRT; PAM sequence: CAGAAT
acaacaacaacaaaaattac

SEQ ID NO: 22005 - DNA, 20 bp, Artificial Sequence
  Description of Artificial Sequence: Synthetic oligonucleotide
  Target: ATXN1; (+) strand; PAM type: NNGRRT; PAM sequence: GTGAGT
acaacaaaaattaccagaat

SEQ ID NO: 22006 - DNA, 20 bp, Artificial Sequence
  Description of Artificial Sequence: Synthetic oligonucleotide
  Target: ATXN1; (+) strand; PAM type: NNGRRT; PAM sequence: CTGGGT
atgatccagaaatcccacga

SEQ ID NO: 22007 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atctaaatgtctaccaacag

SEQ ID NO: 22008 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aaatgtctaccaacagatga

SEQ ID NO: 22009 - DNA, 20 bp, Artificial Sequence
  Description of Artificial Sequence: Synthetic oligonucleotide
  Target: ATXN1; (+) strand; PAM type: NNGRRT; PAM sequence: TGGAAT
agtatagtatatacacacaa

SEQ ID NO: 22010 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aatattattcagccataaaa

SEQ ID NO: 22011 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atccagtcatttgcaacaac

SEQ ID NO: 22012 - DNA, 20 bp, Artificial Sequence
  Description of Artificial Sequence: Synthetic oligonucleotide
  Target: ATXN1; (+) strand; PAM type: NNGRRT; PAM sequence: TGGGAT
agcatgttctcacttatctg

SEQ ID NO: 22013 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ctactgaactcatggacaca

SEQ ID NO: 22014 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ctcatggacacagagagtag

SEQ ID NO: 22015 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gatggctaccaaaggctggg

SEQ ID NO: 22016 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tagggggctggaggggaggt

SEQ ID NO: 22017 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aggggaggtggggatggtta

SEQ ID NO: 22018 - DNA, 20 bp, Artificial Sequence
  Description of Artificial Sequence: Synthetic oligonucleotide
  Target: ATXN1; (+) strand; PAM type: NNGRRT; PAM sequence: TAGAAT
atgggtacaaaaaaagtagt

SEQ ID NO: 22019 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tctactatttgatagcacaa

SEQ ID NO: 22020 - DNA, 20 bp, Artificial Sequence
  Description of Artificial Sequence: Synthetic oligonucleotide
  Target: ATXN1; (+) strand; PAM type: NNGRRT; PAM sequence: AAGAGT
taactgtacattttaaaata

SEQ ID NO: 22021 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tttaaaataaagagtataac

SEQ ID NO: 22022 - DNA, 20 bp, Artificial Sequence
  Description of Artificial Sequence: Synthetic oligonucleotide
  Target: ATXN1; (+) strand; PAM type: NNGRRT; PAM sequence: ATGGAT
taactggagtgtttgttgta

SEQ ID NO: 22023 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ttgttgtaatggataaatgc

SEQ ID NO: 22024 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tgtaatggataaatgcttga

SEQ ID NO: 22025 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggataaatgcttgagtgg

SEQ ID NO: 22026 - DNA, 20 bp, Artificial Sequence
  Description of Artificial Sequence: Synthetic oligonucleotide
  Target: ATXN1; (+) strand; PAM type: NNGRRT; PAM sequence: GTGGAT
ggactatgcagtcaaaaaaa

SEQ ID NO: 22027 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctctcctatgcccaagtata

SEQ ID NO: 22028 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tcataacatttgaggactga

SEQ ID NO: 22029 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctgaaagagtattacattga

SEQ ID NO: 22030 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aaccaatacatatttatttg

SEQ ID NO: 22031 - DNA, 20 bp, Artificial Sequence
  Description of Artificial Sequence: Synthetic oligonucleotide
  Target: ATXN1; (+) strand; PAM type: NNGRRT; PAM sequence: CAGAGT
atatttatttgttgaattta

SEQ ID NO: 22032 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tcaagattgagaaaggcagg

SEQ ID NO: 22033 - DNA, 20 bp, Artificial Sequence
  Description of Artificial Sequence: Synthetic oligonucleotide
  Target: ATXN1; (+) strand; PAM type: NNGRRT; PAM sequence: TTGAGT
cagcaaaaagttgttttggt

SEQ ID NO: 22034 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aaaaagttgttttggtttga

SEQ ID NO: 22035 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaactaacacatataccaca

SEQ ID NO: 22036 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aacacatataccacagggaa

SEQ ID NO: 22037 - DNA, 20 bp, Artificial Sequence
  Description of Artificial Sequence: Synthetic oligonucleotide
  Target: ATXN1; (+) strand; PAM type: NNGRRT; PAM sequence: TAGAAT
cagggaatagaatcacacat

SEQ ID NO: 22038 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cagcactttgggaggccaag

SEQ ID NO: 22039 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccaaggcgg

SEQ ID NO: 22040 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tactcgggaggctgaggcag

SEQ ID NO: 22041 - DNA, 20 bp, Artificial Sequence
  Description of Artificial Sequence: Synthetic oligonucleotide
  Target: ATXN1; (+) strand; PAM type: NNGRRT; PAM sequence: GTGAGT
cccgggaggtggaagctgca

SEQ ID NO: 22042 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ggtggaagctgcagtgagtc

SEQ ID NO: 22043 - DNA, 20 bp, Artificial Sequence
  Description of Artificial Sequence: Synthetic oligonucleotide
  Target: ATXN1; (+) strand; PAM type: NNGRRT; PAM sequence: AAGAAT
catctcaaaaaaaaaaaaaa

SEQ ID NO: 22044 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aaaaaaaaaaagaatattca

SEQ ID NO: 22045 - DNA, 20 bp, Artificial Sequence
  Description of Artificial Sequence: Synthetic oligonucleotide
  Target: ATXN1; (+) strand; PAM type: NNGRRT; PAM sequence: CGGGAT
aggactcaattttaaagact

SEQ ID NO: 22046 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aattttaaagactcgggata

SEQ ID NO: 22047 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ttaaagactcgggataatgg

SEQ ID NO: 22048 - DNA, 20 bp, Artificial Sequence
  Description of Artificial Sequence: Synthetic oligonucleotide
  Target: ATXN1; (+) strand; PAM type: NNGRRT; PAM sequence: AGGGAT
actcgggataatgggtgaat

SEQ ID NO: 22049 - DNA, 20 bp, Artificial Sequence
  Description of Artificial Sequence: Synthetic oligonucleotide
  Target: ATXN1; (+) strand; PAM type: NNGRRT; PAM sequence: TAGAGT
ttgtttcagcccaatcatgg

SEQ ID NO: 22050 - DNA, 20 bp, Artificial Sequence
  Description of Artificial Sequence: Synthetic oligonucleotide
  Target: ATXN1; (+) strand; PAM type: NNGRRT; PAM sequence: TTGAGT
actgaaaaaactgtatgatc

SEQ ID NO: 22051 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aatctaagttccttctcaaa

SEQ ID NO: 22052 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tttggtaaaaatatatgtga

SEQ ID NO: 22053 - DNA, 20 bp, Artificial Sequence
  Description of Artificial Sequence: Synthetic oligonucleotide
  Target: ATXN1; (+) strand; PAM type: NNGRRT; PAM sequence: AAGGGT
acacatccttgccctcaatt

SEQ ID NO: 22054 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gagcatatccccgcaatggg

SEQ ID NO: 22055 - DNA, 20 bp, Artificial Sequence
  Description of Artificial Sequence: Synthetic oligonucleotide
  Target: ATXN1; (+) strand; PAM type: NNGRRT; PAM sequence: ACGAAT
gtgtctccagccatggagac

SEQ ID NO: 22056 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taagtatccaacactgctcc

SEQ ID NO: 22057 - DNA, 20 bp, Artificial Sequence
  Description of Artificial Sequence: Synthetic oligonucleotide
  Target: ATXN1; (+) strand; PAM type: NNGRRT; PAM sequence: CAGAGT
agatgcaaagtagagcaaca

SEQ ID NO: 22058 - DNA, 20 bp, Artificial Sequence
  Description of Artificial Sequence: Synthetic oligonucleotide
  Target: ATXN1; (+) strand; PAM type: NNGRRT; PAM sequence: GGGAGT
cagccgatgcaatttttaag

SEQ ID NO: 22059 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ggggagtggtaatttgtggt

SEQ ID NO: 22060 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tacattttgaccatgtgaaa

SEQ ID NO: 22061 - DNA, 20 bp, Artificial Sequence
  Description of Artificial Sequence: Synthetic oligonucleotide
  Target: ATXN1; (+) strand; PAM type: NNGRRT; PAM sequence: GTGGAT
acagaccttaaatgtcagca

SEQ ID NO: 22062 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ccttaaatgtcagcagtgga

SEQ ID NO: 22063 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tctaggcatttgcaatatca

SEQ ID NO: 22064 - DNA, 20 bp, Artificial Sequence
  Description of Artificial Sequence: Synthetic oligonucleotide
  Target: ATXN1; (+) strand; PAM type: NNGRRT; PAM sequence: CAGAGT
caatgcacttcttataggga

SEQ ID NO: 22065 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ctcgtggtcaccgcttttac

SEQ ID NO: 22066 - DNA, 20 bp, Artificial Sequence
  Description of Artificial Sequence: Synthetic oligonucleotide
  Target: ATXN1; (+) strand; PAM type: NNGRRT; PAM sequence: CTGGGT
caccatcaagactaaatctg

SEQ ID NO: 22067 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggaagatcacttgaggtc

SEQ ID NO: 22068 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tactcgggaggctgaggcag

SEQ ID NO: 22069 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactccaacctgggcaa

SEQ ID NO: 22070 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tgtcgttgtattgtatcatc

SEQ ID NO: 22071 - DNA, 20 bp, Artificial Sequence
  Description of Artificial Sequence: Synthetic oligonucleotide
  Target: ATXN1; (+) strand; PAM type: NNGRRT; PAM sequence: CTGAGT
atatttgccacaaccatttg

SEQ ID NO: 22072 - DNA, 20 bp, Artificial Sequence
  Description of Artificial Sequence: Synthetic oligonucleotide
  Target: ATXN1; (+) strand; PAM type: NNGRRT; PAM sequence: CTGGGT
agtgacaaagctaggtttgt

SEQ ID NO: 22073 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaagccgagggag

SEQ ID NO: 22074 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gaggtggatcacctgaggtc

SEQ ID NO: 22075 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggaggctgaggcag

SEQ ID NO: 22076 - DNA, 20 bp, Artificial Sequence
  Description of Artificial Sequence: Synthetic oligonucleotide
  Target: ATXN1; (+) strand; PAM type: NNGRRT; PAM sequence: CAGGGT
aaaaaaaaaaaaatctttgt

SEQ ID NO: 22077 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tttttgtgaagatagcaagc

SEQ ID NO: 22078 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atgttaataacccaaacaca

SEQ ID NO: 22079 - DNA, 20 bp, Artificial Sequence
  Description of Artificial Sequence: Synthetic oligonucleotide
  Target: ATXN1; (+) strand; PAM type: NNGRRT; PAM sequence: AGGAAT
cccaaacacaaagaatgtgc

SEQ ID NO: 22080 - DNA, 20 bp, Artificial Sequence
  Description of Artificial Sequence: Synthetic oligonucleotide
  Target: ATXN1; (+) strand; PAM type: NNGRRT; PAM sequence: CAGAGT
acttttttcatttattacct

SEQ ID NO: 22081 - DNA, 20 bp, Artificial Sequence
  Description of Artificial Sequence: Synthetic oligonucleotide
  Target: ATXN1; (+) strand; PAM type: NNGRRT; PAM sequence: TCGGAT
atattattatgtgtttctcg

SEQ ID NO: 22082 - DNA, 20 bp, Artificial Sequence
  Description of Artificial Sequence: Synthetic oligonucleotide
  Target: ATXN1; (+) strand; PAM type: NNGRRT; PAM sequence: TTGAGT
acagtctaacacaatttaaa

SEQ ID NO: 22083 - DNA, 20 bp, Artificial Sequence
  Description of Artificial Sequence: Synthetic oligonucleotide
  Target: ATXN1; (+) strand; PAM type: NNGRRT; PAM sequence: GTGAGT
taaattgagttaggacttaa

SEQ ID NO: 22084 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tgtgacccagctctgatagc

SEQ ID NO: 22085 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gacattcaaaatatgcagaa

SEQ ID NO: 22086 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttcaaaatatgcagaaatga

SEQ ID NO: 22087 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cagaaatgaatgaatcctca

SEQ ID NO: 22088 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ataaataaaaggcatgctta

SEQ ID NO: 22089 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aaggcatgcttattgagtcc

SEQ ID NO: 22090 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agcatttcaaagagcaacat

SEQ ID NO: 22091 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ttggtagatatctgttctta

SEQ ID NO: 22092 - DNA, 20 bp, Artificial Sequence
  Description of Artificial Sequence: Synthetic oligonucleotide
  Target: ATXN1; (+) strand; PAM type: NNGRRT; PAM sequence: GAGAGT
agcttaaaatgtaaggggca

SEQ ID NO: 22093 - DNA, 20 bp, Artificial Sequence
  Description of Artificial Sequence: Synthetic oligonucleotide
  Target: ATXN1; (+) strand; PAM type: NNGRRT; PAM sequence: GAGAAT
taaggggcagagagtatttt

SEQ ID NO: 22094 - DNA, 20 bp, Artificial Sequence
  Description of Artificial Sequence: Synthetic oligonucleotide
  Target: ATXN1; (+) strand; PAM type: NNGRRT; PAM sequence: AGGGGT
aatactgattgctatatttc

SEQ ID NO: 22095 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gaagcagtacgattccatgg

SEQ ID NO: 22096 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tacgattccatggaagggtt

SEQ ID NO: 22097 - DNA, 20 bp, Artificial Sequence
  Description of Artificial Sequence: Synthetic oligonucleotide
  Target: ATXN1; (+) strand; PAM type: NNGRRT; PAM sequence: CGGAAT
ttagcagattcatccattgt

SEQ ID NO: 22098 - DNA, 20 bp, Artificial Sequence
  Description of Artificial Sequence: Synthetic oligonucleotide
  Target: ATXN1; (+) strand; PAM type: NNGRRT; PAM sequence: TGGAAT
acttaagagaacatctacac

SEQ ID NO: 22099 - DNA, 20 bp, Artificial Sequence
  Description of Artificial Sequence: Synthetic oligonucleotide
  Target: ATXN1; (+) strand; PAM type: NNGRRT; PAM sequence: GAGGGT
atctacactggaatctactg

SEQ ID NO: 22100 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gaacttaaaatataagttaa

SEQ ID NO: 22101 - DNA, 20 bp, Artificial Sequence
  Description of Artificial Sequence: Synthetic oligonucleotide
  Target: ATXN1; (+) strand; PAM type: NNGRRT; PAM sequence: CTGGGT
caatcaggttttatgatttc

SEQ ID NO: 22102 - DNA, 20 bp, Artificial Sequence
  Description of Artificial Sequence: Synthetic oligonucleotide
  Target: ATXN1; (+) strand; PAM type: NNGRRT; PAM sequence: ACGGGT
tttcctgggtgtctgtgttc

SEQ ID NO: 22103 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ctgggtgtctgtgttcacgg

SEQ ID NO: 22104 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacatggtcaaggtattgaa

SEQ ID NO: 22105 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gagaagcaggaaaccatctt

SEQ ID NO: 22106 - DNA, 20 bp, Artificial Sequence
  Description of Artificial Sequence: Synthetic oligonucleotide
  Target: ATXN1; (+) strand; PAM type: NNGRRT; PAM sequence: ACGAAT
ctacttcaccaaagtttagt

SEQ ID NO: 22107 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gaaatatcacagaggaaagg

SEQ ID NO: 22108 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccgaggcca

SEQ ID NO: 22109 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcag

SEQ ID NO: 22110 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcaggagaattgcttgaacc

SEQ ID NO: 22111 - DNA, 20 bp, Artificial Sequence
  Description of Artificial Sequence: Synthetic oligonucleotide
  Target: ATXN1; (+) strand; PAM type: NNGRRT; PAM sequence: TGGAAT
cacagctctggacacaaaat

SEQ ID NO: 22112 - DNA, 20 bp, Artificial Sequence
  Description of Artificial Sequence: Synthetic oligonucleotide
  Target: ATXN1; (+) strand; PAM type: NNGRRT; PAM sequence: AGGGGT
cttaaaagcagtaatgtaac

SEQ ID NO: 22113 - DNA, 20 bp, Artificial Sequence
  Description of Artificial Sequence: Synthetic oligonucleotide
  Target: ATXN1; (+) strand; PAM type: NNGRRT; PAM sequence: GTGAAT
taagctttattgttttcaaa

SEQ ID NO: 22114 - DNA, 20 bp, Artificial Sequence
  Description of Artificial Sequence: Synthetic oligonucleotide
  Target: ATXN1; (+) strand; PAM type: NNGRRT; PAM sequence: TGGGGT
cttaatttacagaaacaggc

SEQ ID NO: 22115 - DNA, 20 bp, Artificial Sequence
  Description of Artificial Sequence: Synthetic oligonucleotide
  Target: ATXN1; (+) strand; PAM type: NNGRRT; PAM sequence: TAGAAT
cagtttgtcaatacctggtc

SEQ ID NO: 22116 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aagcagatatgggcaaatct

SEQ ID NO: 22117 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttaaaaaatgggcaaaggac

SEQ ID NO: 22118 - DNA, 20 bp, Artificial Sequence
  Description of Artificial Sequence: Synthetic oligonucleotide
  Target: ATXN1; (+) strand; PAM type: NNGRRT; PAM sequence: AAGGAT
agaaaataacaaatgttggc

SEQ ID NO: 22119 - DNA, 20 bp, Artificial Sequence
  Description of Artificial Sequence: Synthetic oligonucleotide
  Target: ATXN1; (+) strand; PAM type: NNGRRT; PAM sequence: ATGGAT
agcaacctaagtgtccatca

SEQ ID NO: 22120 - DNA, 20 bp, Artificial Sequence
  Description of Artificial Sequence: Synthetic oligonucleotide
  Target: ATXN1; (+) strand; PAM type: NNGRRT; PAM sequence: ATGAAT
acctaagtgtccatcaatgg

SEQ ID NO: 22121 - DNA, 20 bp, Artificial Sequence
  Description of Artificial Sequence: Synthetic oligonucleotide
  Target: ATXN1; (+) strand; PAM type: NNGRRT; PAM sequence: ATGGAT
attctgacacatgctacaac

SEQ ID NO: 22122 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aagatgaaaacgttctgaag

SEQ ID NO: 22123 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ggtgatgactgcaatataat

SEQ ID NO: 22124 - DNA, 20 bp, Artificial Sequence
  Description of Artificial Sequence: Synthetic oligonucleotide
  Target: ATXN1; (+) strand; PAM type: NNGRRT; PAM sequence: ATGAAT
acttaaaaatgggaaaaatg

SEQ ID NO: 22125 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gagcttttcaggtgatctgt

SEQ ID NO: 22126 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tatcccaagaagtttcaaat

SEQ ID NO: 22127 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aaatgagagttgaaacttga

SEQ ID NO: 22128 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ctgatgaactgtgacctcgt

SEQ ID NO: 22129 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ggaaatcggcttccacatct

SEQ ID NO: 22130 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aggaatcacttggactaaaa

SEQ ID NO: 22131 - DNA, 20 bp, Artificial Sequence
  Description of Artificial Sequence: Synthetic oligonucleotide
  Target: ATXN1; (+) strand; PAM type: NNGRRT; PAM sequence: CAGAGT
atgtgagagctcctttgatt

SEQ ID NO: 22132 - DNA, 20 bp, Artificial Sequence
  Description of Artificial Sequence: Synthetic oligonucleotide
  Target: ATXN1; (+) strand; PAM type: NNGRRT; PAM sequence: CAGAAT
catgagatttgtaatatggc

SEQ ID NO: 22133 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aatgcttgcaatatcctttt

SEQ ID NO: 22134 - DNA, 20 bp, Artificial Sequence
  Description of Artificial Sequence: Synthetic oligonucleotide
  Target: ATXN1; (+) strand; PAM type: NNGRRT; PAM sequence: GTGGAT
ctcagagacccaatttggca

SEQ ID NO: 22135 - DNA, 20 bp, Artificial Sequence
  Description of Artificial Sequence: Synthetic oligonucleotide
  Target: ATXN1; (+) strand; PAM type: NNGRRT; PAM sequence: AGGAGT
acccaatttggcagtggatc

SEQ ID NO: 22136 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ggcaaagccaacctatcttt

SEQ ID NO: 22137 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aaaactcacaatctccagtt

SEQ ID NO: 22138 - DNA, 20 bp, Artificial Sequence
  Description of Artificial Sequence: Synthetic oligonucleotide
  Target: ATXN1; (+) strand; PAM type: NNGRRT; PAM sequence: CTGAGT
cgtttgaaatgtaagctgct

SEQ ID NO: 22139 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tatttgcatagcactattcc

SEQ ID NO: 22140 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttgcaaaagtcaaactgata

SEQ ID NO: 22141 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gttgcattgcctactacaag

SEQ ID NO: 22142 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ctactacaagcagaataacg

SEQ ID NO: 22143 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttttttcctatattcttggt

SEQ ID NO: 22144 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tgccaaaataaagtagaagg

SEQ ID NO: 22145 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tgggtaatggtttagtacat

SEQ ID NO: 22146 - DNA, 20 bp, Artificial Sequence
  Description of Artificial Sequence: Synthetic oligonucleotide
  Target: ATXN1; (+) strand; PAM type: NNGRRT; PAM sequence: GAGAAT
acttttccaactcagttatt

SEQ ID NO: 22147 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gttattgagaatggccatta

SEQ ID NO: 22148 - DNA, 20 bp, Artificial Sequence
  Description of Artificial Sequence: Synthetic oligonucleotide
  Target: ATXN1; (+) strand; PAM type: NNGRRT; PAM sequence: AAGAGT
caaaaaattttctgaccgtt

SEQ ID NO: 22149 - DNA, 20 bp, Artificial Sequence
  Description of Artificial Sequence: Synthetic oligonucleotide
  Target: ATXN1; (+) strand; PAM type: NNGRRT; PAM sequence: GAGAAT
attttttgacagttttgtta

SEQ ID NO: 22150 - DNA, 20 bp, Artificial Sequence
  Description of Artificial Sequence: Synthetic oligonucleotide
  Target: ATXN1; (+) strand; PAM type: NNGRRT; PAM sequence: CAGGGT
agaggaaaaaaaaataaatt

SEQ ID NO: 22151 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aaaaaaaataaattcagggt

SEQ ID NO: 22152 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttgcttctagcctcctcatc

SEQ ID NO: 22153 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tcttgtataaacagctttct

SEQ ID NO: 22154 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gtcatttgattctagagggc

SEQ ID NO: 22155 - DNA, 20 bp, Artificial Sequence
  Description of Artificial Sequence: Synthetic oligonucleotide
  Target: ATXN1; (+) strand; PAM type: NNGRRT; PAM sequence: AGGAAT
agggcagggcatctgcccac

SEQ ID NO: 22156 - DNA, 20 bp, Artificial Sequence
  Description of Artificial Sequence: Synthetic oligonucleotide
  Target: ATXN1; (+) strand; PAM type: NNGRRT; PAM sequence: TTGGAT
agcacagcaccaagtctgac

SEQ ID NO: 22157 - DNA, 20 bp, Artificial Sequence
  Description of Artificial Sequence: Synthetic oligonucleotide
  Target: ATXN1; (+) strand; PAM type: NNGRRT; PAM sequence: CTGAAT
caagtctgacttggattgag

SEQ ID NO: 22158 - DNA, 20 bp, Artificial Sequence
  Description of Artificial Sequence: Synthetic oligonucleotide
  Target: ATXN1; (+) strand; PAM type: NNGRRT; PAM sequence: TTGAGT
agctgaataaatgaaatctg

SEQ ID NO: 22159 - DNA, 20 bp, Artificial Sequence
  Description of Artificial Sequence: Synthetic oligonucleotide
  Target: ATXN1; (+) strand; PAM type: NNGRRT; PAM sequence: TAGGAT
aggctcctcctgaagtgaac

SEQ ID NO: 22160 - DNA, 20 bp, Artificial Sequence
  Description of Artificial Sequence: Synthetic oligonucleotide
  Target: ATXN1; (+) strand; PAM type: NNGRRT; PAM sequence: AGGGGT
attctccaataaaacaaacc

SEQ ID NO: 22161 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ctgattctagtactgtgaca

SEQ ID NO: 22162 - DNA, 20 bp, Artificial Sequence
  Description of Artificial Sequence: Synthetic oligonucleotide
  Target: ATXN1; (+) strand; PAM type: NNGRRT; PAM sequence: CTGGAT
acaaaataaacaacatagta

SEQ ID NO: 22163 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tagtactggattagaaccta

SEQ ID NO: 22164 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aaagaataaaataaacaccc

SEQ ID NO: 22165 - DNA, 20 bp, Artificial Sequence
  Description of Artificial Sequence: Synthetic oligonucleotide
  Target: ATXN1; (+) strand; PAM type: NNGRRT; PAM sequence: AGGAGT
aacacgcatctcttgagcaa

SEQ ID NO: 22166 - DNA, 20 bp, Artificial Sequence
  Description of Artificial Sequence: Synthetic oligonucleotide
  Target: ATXN1; (+) strand; PAM type: NNGRRT; PAM sequence: ACGAGT
tgcacagtgacttccttcca

SEQ ID NO: 22167 - DNA, 20 bp, Artificial Sequence
  Description of Artificial Sequence: Synthetic oligonucleotide
  Target: ATXN1; (+) strand; PAM type: NNGRRT; PAM sequence: AAGGGT
acgagtagtacagtatggaa

SEQ ID NO: 22168 - DNA, 20 bp, Artificial Sequence
  Description of Artificial Sequence: Synthetic oligonucleotide
  Target: ATXN1; (+) strand; PAM type: NNGRRT; PAM sequence: GTGAGT
cagtatggaaaagggtgtgt

SEQ ID NO: 22169 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgtgagtgtgtctgtgtaca

SEQ ID NO: 22170 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gtgacaatctgccaatttta

SEQ ID NO: 22171 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tttgtggactgtccctcaat

SEQ ID NO: 22172 - DNA, 20 bp, Artificial Sequence
  Description of Artificial Sequence: Synthetic oligonucleotide
  Target: ATXN1; (+) strand; PAM type: NNGRRT; PAM sequence: GAGGGT
cagcactttgtggggccaaa

SEQ ID NO: 22173 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgtggggccaaagagg

SEQ ID NO: 22174 - DNA, 20 bp, Artificial Sequence
  Description of Artificial Sequence: Synthetic oligonucleotide
  Target: ATXN1; (+) strand; PAM type: NNGRRT; PAM sequence: CTGGAT
aaaaccaaaaaccaaattag

SEQ ID NO: 22175 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tactcagggggctaagatgg

SEQ ID NO: 22176 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactccaacctgggcga

SEQ ID NO: 22177 - DNA, 20 bp, Artificial Sequence
  Description of Artificial Sequence: Synthetic oligonucleotide
  Target: ATXN1; (+) strand; PAM type: NNGRRT; PAM sequence: TTGAGT
aagccaatattttattttga

SEQ ID NO: 22178 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aactaaaacatgatggactg

SEQ ID NO: 22179 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aaaatctaggtggcaagttt

SEQ ID NO: 22180 - DNA, 20 bp, Artificial Sequence
  Description of Artificial Sequence: Synthetic oligonucleotide
  Target: ATXN1; (+) strand; PAM type: NNGRRT; PAM sequence: AAGAGT
acaactctgcccagtcatag

SEQ ID NO: 22181 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ttaattagcaaaaagccata

SEQ ID NO: 22182 - DNA, 20 bp, Artificial Sequence
  Description of Artificial Sequence: Synthetic oligonucleotide
  Target: ATXN1; (+) strand; PAM type: NNGRRT; PAM sequence: TTGGAT
cctccaatcatttttgtggc

SEQ ID NO: 22183 - DNA, 20 bp, Artificial Sequence
  Description of Artificial Sequence: Synthetic oligonucleotide
  Target: ATXN1; (+) strand; PAM type: NNGRRT; PAM sequence: ATGGAT
caatcatttttgtggcttgg

SEQ ID NO: 22184 - DNA, 20 bp, Artificial Sequence
  Description of Artificial Sequence: Synthetic oligonucleotide
  Target: ATXN1; (+) strand; PAM type: NNGRRT; PAM sequence: AGGAGT
taagaggtttttcttgaaat

SEQ ID NO: 22185 - DNA, 20 bp, Artificial Sequence
  Description of Artificial Sequence: Synthetic oligonucleotide
  Target: ATXN1; (+) strand; PAM type: NNGRRT; PAM sequence: CTGAAT
taagtgtgcatcaaccgtcc

SEQ ID NO: 22186 - DNA, 20 bp, Artificial Sequence
  Description of Artificial Sequence: Synthetic oligonucleotide
  Target: ATXN1; (+) strand; PAM type: NNGRRT; PAM sequence: TAGAGT
taacaaatgttaaacctgtc

SEQ ID NO: 22187 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aatggcctcgccaaccgcca

SEQ ID NO: 22188 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ataagtggctgcctatgtat

SEQ ID NO: 22189 - DNA, 20 bp, Artificial Sequence
  Description of Artificial Sequence: Synthetic oligonucleotide
  Target: ATXN1; (+) strand; PAM type: NNGRRT; PAM sequence: ATGGAT
actttgggaggctggggcag

SEQ ID NO: 22190 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cagatggatcacctgaggtc

SEQ ID NO: 22191 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tagtcggcaggctggggcag

SEQ ID NO: 22192 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgcactccagtctgggcaac

SEQ ID NO: 22193 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggccaaggtgg

SEQ ID NO: 22194 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggcggatcacctgaggtc

SEQ ID NO: 22195 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggaggtcaaagcag

SEQ ID NO: 22196 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gaaatatgtccactgaaaat

SEQ ID NO: 22197 - DNA, 20 bp, Artificial Sequence
  Description of Artificial Sequence: Synthetic oligonucleotide
  Target: ATXN1; (+) strand; PAM type: NNGRRT; PAM sequence: CTGGGT
caccggggcagagccaatat

SEQ ID NO: 22198 - DNA, 20 bp, Artificial Sequence
  Description of Artificial Sequence: Synthetic oligonucleotide
  Target: ATXN1; (+) strand; PAM type: NNGRRT; PAM sequence: GAGGAT
atttacataacaaaagttgt

SEQ ID NO: 22199 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aacaaaagttgtgaggatta

SEQ ID NO: 22200 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tttaattatactttaagttt

SEQ ID NO: 22201 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tcattgttcaattcccacct

SEQ ID NO: 22202 - DNA, 20 bp, Artificial Sequence
  Description of Artificial Sequence: Synthetic oligonucleotide
  Target: ATXN1; (+) strand; PAM type: NNGRRT; PAM sequence: TGGGGT
cccacctatgagtgagaaca

SEQ ID NO: 22203 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gatagtctcgctctgtcacc

SEQ ID NO: 22204 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcgctctgtcacccagga

SEQ ID NO: 22205 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tcttgttttttcagtagaga

SEQ ID NO: 22206 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cagggtttcaccatgttgtc

SEQ ID NO: 22207 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcggcctcccaaagtgc

SEQ ID NO: 22208 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aaagtgctgggattacaggc

SEQ ID NO: 22209 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aggaccagttcagcaacagc

SEQ ID NO: 22210 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tccacttttcattttataac

SEQ ID NO: 22211 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agctctgtcccaccccactg

SEQ ID NO: 22212 - DNA, 20 bp, Artificial Sequence
  Description of Artificial Sequence: Synthetic oligonucleotide
  Target: ATXN1; (+) strand; PAM type: NNGRRT; PAM sequence: GAGAAT
acacggtcatggaagttatg

SEQ ID NO: 22213 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tcatggaagttatggagaat

SEQ ID NO: 22214 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ccccaatatctcacccagat

SEQ ID NO: 22215 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aacaaggacattctataacc

SEQ ID NO: 22216 - DNA, 20 bp, Artificial Sequence
  Description of Artificial Sequence: Synthetic oligonucleotide
  Target: ATXN1; (+) strand; PAM type: NNGRRT; PAM sequence: TCGGAT
ccacctctgtggcttagtca

SEQ ID NO: 22217 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tcagcctcaaggtcaccgac

SEQ ID NO: 22218 - DNA, 20 bp, Artificial Sequence
  Description of Artificial Sequence: Synthetic oligonucleotide
  Target: ATXN1; (+) strand; PAM type: NNGRRT; PAM sequence: AGGAGT
agcctttgtttaagtctgag

SEQ ID NO: 22219 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aaggagaaaaggagaggaaa

SEQ ID NO: 22220 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gaggatccatgccacagaaa

SEQ ID NO: 22221 - DNA, 20 bp, Artificial Sequence
  Description of Artificial Sequence: Synthetic oligonucleotide
  Target: ATXN1; (+) strand; PAM type: NNGRRT; PAM sequence: CGGGAT
cttgcctttccgctcgaaca

SEQ ID NO: 22222 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgacaggggactgcaatgct

SEQ ID NO: 22223 - DNA, 20 bp, Artificial Sequence
  Description of Artificial Sequence: Synthetic oligonucleotide
  Target: ATXN1; (+) strand; PAM type: NNGRRT; PAM sequence: CAGAAT
caatgctgagaatcaagaaa

SEQ ID NO: 22224 - DNA, 20 bp, Artificial Sequence
  Description of Artificial Sequence: Synthetic oligonucleotide
  Target: ATXN1; (+) strand; PAM type: NNGRRT; PAM sequence: TAGAGT
atcaccaataataaacatta

SEQ ID NO: 22225 - DNA, 20 bp, Artificial Sequence
  Description of Artificial Sequence: Synthetic oligonucleotide
  Target: ATXN1; (+) strand; PAM type: NNGRRT; PAM sequence: CGGAAT
attataattatttttggaga

SEQ ID NO: 22226 - DNA, 20 bp, Artificial Sequence
  Description of Artificial Sequence: Synthetic oligonucleotide
  Target: ATXN1; (+) strand; PAM type: NNGRRT; PAM sequence: TGGAGT
atcttgttctgtcaccaggc

SEQ ID NO: 22227 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcaatgcaacctccgcctc

SEQ ID NO: 22228 - DNA, 20 bp, Artificial Sequence
  Description of Artificial Sequence: Synthetic oligonucleotide
  Target: ATXN1; (+) strand; PAM type: NNGRRT; PAM sequence: ACGGGT
tttttatatttttagtagag

SEQ ID NO: 22229 - DNA, 20 bp, Artificial Sequence
  Description of Artificial Sequence: Synthetic oligonucleotide
  Target: ATXN1; (+) strand; PAM type: NNGRRT; PAM sequence: CAGGAT
acgggtttcaccatgttggc

SEQ ID NO: 22230 - DNA, 20 bp, Artificial Sequence
  Description of Artificial Sequence: Synthetic oligonucleotide
  Target: ATXN1; (+) strand; PAM type: NNGRRT; PAM sequence: CAGAGT
atccacccacctcagcctcc

SEQ ID NO: 22231 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcagcctcccagagtgc

SEQ ID NO: 22232 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tctcccaacagcccagtgag

SEQ ID NO: 22233 - DNA, 20 bp, Artificial Sequence
  Description of Artificial Sequence: Synthetic oligonucleotide
  Target: ATXN1; (+) strand; PAM type: NNGRRT; PAM sequence: TGGAGT
attattcccattgtacagat

SEQ ID NO: 22234 - DNA, 20 bp, Artificial Sequence
  Description of Artificial Sequence: Synthetic oligonucleotide
  Target: ATXN1; (+) strand; PAM type: NNGRRT; PAM sequence: GAGGGT
attggagtactgaggcacaa

SEQ ID NO: 22235 - DNA, 20 bp, Artificial Sequence
  Description of Artificial Sequence: Synthetic oligonucleotide
  Target: ATXN1; (+) strand; PAM type: NNGRRT; PAM sequence: TGGGAT
cactgataaatggctgcagt

SEQ ID NO: 22236 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gcagttgggattcaaagcca

SEQ ID NO: 22237 - DNA, 20 bp, Artificial Sequence
  Description of Artificial Sequence: Synthetic oligonucleotide
  Target: ATXN1; (+) strand; PAM type: NNGRRT; PAM sequence: TAGAGT
aaagccaaggagttaggctc

SEQ ID NO: 22238 - DNA, 20 bp, Artificial Sequence
  Description of Artificial Sequence: Synthetic oligonucleotide
  Target: ATXN1; (+) strand; PAM type: NNGRRT; PAM sequence: TGGAAT
acatgctttttccctctgct

SEQ ID NO: 22239 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gctgtctcatgtatttactt

SEQ ID NO: 22240 - DNA, 20 bp, Artificial Sequence
  Description of Artificial Sequence: Synthetic oligonucleotide
  Target: ATXN1; (+) strand; PAM type: NNGRRT; PAM sequence: TAGAGT
ggtgttcaataccgtgttca

SEQ ID NO: 22241 - DNA, 20 bp, Artificial Sequence
  Description of Artificial Sequence: Synthetic oligonucleotide
  Target: ATXN1; (+) strand; PAM type: NNGRRT; PAM sequence: ATGAAT
cgtgttcatagagtgaaggt

SEQ ID NO: 22242 - DNA, 20 bp, Artificial Sequence
  Description of Artificial Sequence: Synthetic oligonucleotide
  Target: ATXN1; (+) strand; PAM type: NNGRRT; PAM sequence: GAGAAT
attgctgtgggagacaggct

SEQ ID NO: 22243 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttgtctaaggtcatattgct

SEQ ID NO: 22244 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aaaactattttacatagcct

SEQ ID NO: 22245 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ggggagcctctggggctttg

SEQ ID NO: 22246 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ccagccctgaaactttgaga

SEQ ID NO: 22247 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ctgacccatgggggaaggca

SEQ ID NO: 22248 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ctggacgcctttgagaaatc

SEQ ID NO: 22249 - DNA, 20 bp, Artificial Sequence
  Description of Artificial Sequence: Synthetic oligonucleotide
  Target: ATXN1; (+) strand; PAM type: NNGRRT; PAM sequence: CTGAGT
atcagaggaggcagaaagcc

SEQ ID NO: 22250 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gcagtggcacaactaaaact

SEQ ID NO: 22251 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gacagcaaaatgctcaagtt

SEQ ID NO: 22252 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tgggggaaaacgccaccacc

SEQ ID NO: 22253 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gataaccttttccccactgc

SEQ ID NO: 22254 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ccccactgcctgagttgctc

SEQ ID NO: 22255 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gagttgctcttgagtgccta

SEQ ID NO: 22256 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gagaagcgcccaggcttcca

SEQ ID NO: 22257 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gcccttccctggctcgtccc

SEQ ID NO: 22258 - DNA, 20 bp, Artificial Sequence
  Description of Artificial Sequence: Synthetic oligonucleotide
  Target: ATXN1; (+) strand; PAM type: NNGRRT; PAM sequence: ACGAGT
gcagcagccaaatacaacta

SEQ ID NO: 22259 - DNA, 20 bp, Artificial Sequence
  Description of Artificial Sequence: Synthetic oligonucleotide
  Target: ATXN1; (+) strand; PAM type: NNGRRT; PAM sequence: GAGGAT
cagttgtcctcccatccatg

SEQ ID NO: 22260 - DNA, 20 bp, Artificial Sequence
  Description of Artificial Sequence: Synthetic oligonucleotide
  Target: ATXN1; (+) strand; PAM type: NNGRRT; PAM sequence: ATGAAT
cccagtggacgcctaaaacc

SEQ ID NO: 22261 - DNA, 20 bp, Artificial Sequence
  Description of Artificial Sequence: Synthetic oligonucleotide
  Target: ATXN1; (+) strand; PAM type: NNGRRT; PAM sequence: TAGAGT
ctatacatatacacccatga

SEQ ID NO: 22262 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tatactgtactaaaagttat

SEQ ID NO: 22263 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tttttgtaccacgcttgact

SEQ ID NO: 22264 - DNA, 20 bp, Artificial Sequence
  Description of Artificial Sequence: Synthetic oligonucleotide
  Target: ATXN1; (+) strand; PAM type: NNGRRT; PAM sequence: GGGGGT
agaaaatgacaccgaagatg

SEQ ID NO: 22265 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gggggaactactgtatcaac

SEQ ID NO: 22266 - DNA, 20 bp, Artificial Sequence
  Description of Artificial Sequence: Synthetic oligonucleotide
  Target: ATXN1; (+) strand; PAM type: NNGRRT; PAM sequence: GGGAAT
catgtccacaaatggccttt

SEQ ID NO: 22267 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ctttgggaatgatgggacat

SEQ ID NO: 22268 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ccagggagctgagctctggc

SEQ ID NO: 22269 - DNA, 20 bp, Artificial Sequence
  Description of Artificial Sequence: Synthetic oligonucleotide
  Target: ATXN1; (+) strand; PAM type: NNGRRT; PAM sequence: GGGGAT
atttctaattcttttcattt

SEQ ID NO: 22270 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gaaagtatgccaagagaaaa

SEQ ID NO: 22271 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aaaagaatgatcaattacat

SEQ ID NO: 22272 - DNA, 20 bp, Artificial Sequence
  Description of Artificial Sequence: Synthetic oligonucleotide
  Target: ATXN1; (+) strand; PAM type: NNGRRT; PAM sequence: GGGGAT
cctaaatatgccttaaacca

SEQ ID NO: 22273 - DNA, 20 bp, Artificial Sequence
  Description of Artificial Sequence: Synthetic oligonucleotide
  Target: ATXN1; (+) strand; PAM type: NNGRRT; PAM sequence: GAGAGT
aaaaaaaaaaaagagagaga

SEQ ID NO: 22274 - DNA, 20 bp, Artificial Sequence
  Description of Artificial Sequence: Synthetic oligonucleotide
  Target: ATXN1; (+) strand; PAM type: NNGRRT; PAM sequence: AGGAAT
taagcatgcctagggctcag

SEQ ID NO: 22275 - DNA, 20 bp, Artificial Sequence
  Description of Artificial Sequence: Synthetic oligonucleotide
  Target: ATXN1; (+) strand; PAM type: NNGRRT; PAM sequence: TTGAGT
atgcttttagagcttcatgc

SEQ ID NO: 22276 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttaaaaattaactctaacct

SEQ ID NO: 22277 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tagaagccaatgacttccca

SEQ ID NO: 22278 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ttgttggctagatttgtcct

SEQ ID NO: 22279 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gatttgtcctgggagtactc

SEQ ID NO: 22280 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gggtctcgcaacaaaagtaa

SEQ ID NO: 22281 - DNA, 20 bp, Artificial Sequence
  Description of Artificial Sequence: Synthetic oligonucleotide
  Target: ATXN1; (+) strand; PAM type: NNGRRT; PAM sequence: AAGAAT
caaaatataataatgttatc

SEQ ID NO: 22282 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ggagatgatgagaggaacat

SEQ ID NO: 22283 - DNA, 20 bp, Artificial Sequence
  Description of Artificial Sequence: Synthetic oligonucleotide
  Target: ATXN1; (+) strand; PAM type: NNGRRT; PAM sequence: CTGGGT
atgaagagaaaattccagtc

SEQ ID NO: 22284 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tttcctaatcagtaaaacaa

SEQ ID NO: 22285 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tcagtaaaacaagggagttg

SEQ ID NO: 22286 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tttctctttgccagcaggga

SEQ ID NO: 22287 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ggttgtgcctttgacctcag

SEQ ID NO: 22288 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cggctggccaagttgtggcg

SEQ ID NO: 22289 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cgggaccctcctaagaacac

SEQ ID NO: 22290 - DNA, 20 bp, Artificial Sequence
  Description of Artificial Sequence: Synthetic oligonucleotide
  Target: ATXN1; (+) strand; PAM type: NNGRRT; PAM sequence: CTGGGT
acttttgggggcttaaaatc

SEQ ID NO: 22291 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actccccctaatgacagcta

SEQ ID NO: 22292 - DNA, 20 bp, Artificial Sequence
  Description of Artificial Sequence: Synthetic oligonucleotide
  Target: ATXN1; (+) strand; PAM type: NNGRRT; PAM sequence: TTGGGT
cctaatgacagctagaggat

SEQ ID NO: 22293 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ttgggtgtgtattcaattct

SEQ ID NO: 22294 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tgagtctatgaccctacatc

SEQ ID NO: 22295 - DNA, 20 bp, Artificial Sequence
  Description of Artificial Sequence: Synthetic oligonucleotide
  Target: ATXN1; (+) strand; PAM type: NNGRRT; PAM sequence: TGGGGT
accctacatctgggatgctg

SEQ ID NO: 22296 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcgttggcgtgttatggcac

SEQ ID NO: 22297 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tatggcactgggattcaagt

SEQ ID NO: 22298 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tgaacatctaagatgagagc

SEQ ID NO: 22299 - DNA, 20 bp, Artificial Sequence
  Description of Artificial Sequence: Synthetic oligonucleotide
  Target: ATXN1; (+) strand; PAM type: NNGRRT; PAM sequence: GAGGAT
catctgagatcctaataagg

SEQ ID NO: 22300 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ttagcttttctaagggaggg

SEQ ID NO: 22301 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ttcgaaaggacaaaatggaa

SEQ ID NO: 22302 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aatggaaaggaatttagggc

SEQ ID NO: 22303 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gtgtggaaggaggcgagaag

SEQ ID NO: 22304 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gatgatcacagccaggcttc

SEQ ID NO: 22305 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gtccaggtatgtagagacaa

SEQ ID NO: 22306 - DNA, 20 bp, Artificial Sequence
  Description of Artificial Sequence: Synthetic oligonucleotide
  Target: ATXN1; (+) strand; PAM type: NNGRRT; PAM sequence: TGGGAT
caaatacgcattccatgttg

SEQ ID NO: 22307 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctaatagaagcttcttggaa

SEQ ID NO: 22308 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tctttggtcttacagcgatc

SEQ ID NO: 22309 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atgttccagattaataggag

SEQ ID NO: 22310 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tccagattaataggagatga

SEQ ID NO: 22311 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tcaagtagcaaagtggaggt

SEQ ID NO: 22312 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gaacacataacattttgagg

SEQ ID NO: 22313 - DNA, 20 bp, Artificial Sequence
  Description of Artificial Sequence: Synthetic oligonucleotide
  Target: ATXN1; (+) strand; PAM type: NNGRRT; PAM sequence: CAGGGT
acagcatgtattcttcaatt

SEQ ID NO: 22314 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tattcaagtaaacaaccttg

SEQ ID NO: 22315 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gagagctaacaagagaacac

SEQ ID NO: 22316 - DNA, 20 bp, Artificial Sequence
  Description of Artificial Sequence: Synthetic oligonucleotide
  Target: ATXN1; (+) strand; PAM type: NNGRRT; PAM sequence: AGGAGT
agtttcaaaataggacctaa

SEQ ID NO: 22317 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aggagtttgcgctataggag

SEQ ID NO: 22318 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cctgaaaatattcacattta

SEQ ID NO: 22319 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tgagaaatagagagcagctt

SEQ ID NO: 22320 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gttaagaaataaaaaatggg

SEQ ID NO: 22321 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gcaaagggctttctttcctt

SEQ ID NO: 22322 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gctttctttccttcagagta

SEQ ID NO: 22323 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tctgctgctgttcctgagaa

SEQ ID NO: 22324 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gccagtaggagggcgatggg

SEQ ID NO: 22325 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aagtatttcattaggaacca

SEQ ID NO: 22326 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tggctagaaatcagaaaatc

SEQ ID NO: 22327 - DNA, 20 bp, Artificial Sequence
  Description of Artificial Sequence: Synthetic oligonucleotide
  Target: ATXN1; (+) strand; PAM type: NNGRRT; PAM sequence: AAGGGT
acttctgacatacttataaa

SEQ ID NO: 22328 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttatgtttaaggtattttca

SEQ ID NO: 22329 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aggtgagatctcctatgtta

SEQ ID NO: 22330 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ttattatgtaactgtaccct

SEQ ID NO: 22331 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ggtgatggcaatgagacaat

SEQ ID NO: 22332 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gccagcaaatgcctaccatg

SEQ ID NO: 22333 - DNA, 20 bp, Artificial Sequence
  Description of Artificial Sequence: Synthetic oligonucleotide
  Target: ATXN1; (+) strand; PAM type: NNGRRT; PAM sequence: GTGGAT
agagagaagcggtggtgtgt

SEQ ID NO: 22334 - DNA, 20 bp, Artificial Sequence
  Description of Artificial Sequence: Synthetic oligonucleotide
  Target: ATXN1; (+) strand; PAM type: NNGRRT; PAM sequence: TGGGGT
acctgcctgtgttagtttcc

SEQ ID NO: 22335 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tccttccaggaggtgcaaag

SEQ ID NO: 22336 - DNA, 20 bp, Artificial Sequence
  Description of Artificial Sequence: Synthetic oligonucleotide
  Target: ATXN1; (+) strand; PAM type: NNGRRT; PAM sequence: CCGGAT
tcccagcttctggtggcttt

SEQ ID NO: 22337 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tttcccctttttacaaggag

SEQ ID NO: 22338 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tcctcacctacaggcatgtg

SEQ ID NO: 22339 - DNA, 20 bp, Artificial Sequence
  Description of Artificial Sequence: Synthetic oligonucleotide
  Target: ATXN1; (+) strand; PAM type: NNGRRT; PAM sequence: TAGAGT
attctgttgtgtgaacatcg

SEQ ID NO: 22340 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctacactgcatgatactgta

SEQ ID NO: 22341 - DNA, 20 bp, Artificial Sequence
  Description of Artificial Sequence: Synthetic oligonucleotide
  Target: ATXN1; (+) strand; PAM type: NNGRRT; PAM sequence: ATGAAT
acctgtatagggcacttccc

SEQ ID NO: 22342 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cttcccatgaatggagcttg

SEQ ID NO: 22343 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttgcaggattggaagttgct

SEQ ID NO: 22344 - DNA, 20 bp, Artificial Sequence
  Description of Artificial Sequence: Synthetic oligonucleotide
  Target: ATXN1; (+) strand; PAM type: NNGRRT; PAM sequence: GTGAGT
aggattggaagttgctctgg

SEQ ID NO: 22345 - DNA, 20 bp, Artificial Sequence
  Description of Artificial Sequence: Synthetic oligonucleotide
  Target: ATXN1; (+) strand; PAM type: NNGRRT; PAM sequence: GTGAGT
aagttgctctgggtgagtca

SEQ ID NO: 22346 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tgctctgggtgagtcagtga

SEQ ID NO: 22347 - DNA, 20 bp, Artificial Sequence
  Description of Artificial Sequence: Synthetic oligonucleotide
  Target: ATXN1; (+) strand; PAM type: NNGRRT; PAM sequence: GCGAAT
agtcagtgagtgggtggtga

SEQ ID NO: 22348 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cagcactttgggaggccgag

SEQ ID NO: 22349 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccgaggcgg

SEQ ID NO: 22350 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggtggattgcttgaggcc

SEQ ID NO: 22351 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tttgagaccagcctgaccaa

SEQ ID NO: 22352 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcag

SEQ ID NO: 22353 - DNA, 20 bp, Artificial Sequence
  Description of Artificial Sequence: Synthetic oligonucleotide
  Target: ATXN1; (+) strand; PAM type: NNGRRT; PAM sequence: CAGGGT
cgcattagtctaggcctata

SEQ ID NO: 22354 - DNA, 20 bp, Artificial Sequence
  Description of Artificial Sequence: Synthetic oligonucleotide
  Target: ATXN1; (+) strand; PAM type: NNGRRT; PAM sequence: CAGGAT
agtctaggcctatacagggt

SEQ ID NO: 22355 - DNA, 20 bp, Artificial Sequence
  Description of Artificial Sequence: Synthetic oligonucleotide
  Target: ATXN1; (+) strand; PAM type: NNGRRT; PAM sequence: CCGAAT
atcaagcattatgtgctgta

SEQ ID NO: 22356 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ttacatgactggcagcacag

SEQ ID NO: 22357 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tgcagcatcacagcaaacat

SEQ ID NO: 22358 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tcacagcaaacatatgagta

SEQ ID NO: 22359 - DNA, 20 bp, Artificial Sequence
  Description of Artificial Sequence: Synthetic oligonucleotide
  Target: ATXN1; (+) strand; PAM type: NNGRRT; PAM sequence: GAGGAT
taggtgtctgttgtcccaca

SEQ ID NO: 22360 - DNA, 20 bp, Artificial Sequence
  Description of Artificial Sequence: Synthetic oligonucleotide
  Target: ATXN1; (+) strand; PAM type: NNGRRT; PAM sequence: AAGAAT
actgcttaaagggcacattc

SEQ ID NO: 22361 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggcagagatgg

SEQ ID NO: 22362 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tgggcggatcacctgaggct

SEQ ID NO: 22363 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tactcaggaggctcaggcag

SEQ ID NO: 22364 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aaaaaaaaaaaaaaaaaaaa

SEQ ID NO: 22365 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tgccattctcactcataagt

SEQ ID NO: 22366 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ggaaggggaacaacacacac

SEQ ID NO: 22367 - DNA, 20 bp, Artificial Sequence
  Description of Artificial Sequence: Synthetic oligonucleotide
  Target: ATXN1; (+) strand; PAM type: NNGRRT; PAM sequence: TGGGGT
caccggggtctgttggggac

SEQ ID NO: 22368 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tacaaaaaaaaaaaaaaaaa

SEQ ID NO: 22369 - DNA, 20 bp, Artificial Sequence
  Description of Artificial Sequence: Synthetic oligonucleotide
  Target: ATXN1; (+) strand; PAM type: NNGRRT; PAM sequence: ATGGAT
caagtggtcactggttttac

SEQ ID NO: 22370 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gtatatttgggacaatctga

SEQ ID NO: 22371 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tgagagggtatcctagaaaa

SEQ ID NO: 22372 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cctttcatgcataatagttg

SEQ ID NO: 22373 - DNA, 20 bp, Artificial Sequence
  Description of Artificial Sequence: Synthetic oligonucleotide
  Target: ATXN1; (+) strand; PAM type: NNGRRT; PAM sequence: TCGAAT
gagccaaaatactcatctct

SEQ ID NO: 22374 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gtctgtattagattatcaaa

SEQ ID NO: 22375 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tatttttccttataaaaatc

SEQ ID NO: 22376 - DNA, 20 bp, Artificial Sequence
  Description of Artificial Sequence: Synthetic oligonucleotide
  Target: ATXN1; (+) strand; PAM type: NNGRRT; PAM sequence: ATGAGT
caacttgcctaaataaacta

SEQ ID NO: 22377 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gttgacagtggacctgaagt

SEQ ID NO: 22378 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aactagtatggcttttcaga

SEQ ID NO: 22379 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gagataaaataacataaatg

SEQ ID NO: 22380 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gaagaataaaaagaaaaatc

SEQ ID NO: 22381 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aagccacatgtatttctgtg

SEQ ID NO: 22382 - DNA, 20 bp, Artificial Sequence
  Description of Artificial Sequence: Synthetic oligonucleotide
  Target: ATXN1; (+) strand; PAM type: NNGRRT; PAM sequence: ACGGAT
ttctgtgatgggtttgcaga

SEQ ID NO: 22383 - DNA, 20 bp, Artificial Sequence
  Description of Artificial Sequence: Synthetic oligonucleotide
  Target: ATXN1; (+) strand; PAM type: NNGRRT; PAM sequence: GAGAAT
acttgtgattggtgaaaaca

SEQ ID NO: 22384 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tccctttggtctttcacgat

SEQ ID NO: 22385 - DNA, 20 bp, Artificial Sequence
  Description of Artificial Sequence: Synthetic oligonucleotide
  Target: ATXN1; (+) strand; PAM type: NNGRRT; PAM sequence: TGGAAT
agaaagattccagaaggaag

SEQ ID NO: 22386 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aaagaagaggttacatggtg

SEQ ID NO: 22387 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ggagggtgtcaaaggtcttg

SEQ ID NO: 22388 - DNA, 20 bp, Artificial Sequence
  Description of Artificial Sequence: Synthetic oligonucleotide
  Target: ATXN1; (+) strand; PAM type: NNGRRT; PAM sequence: TTGAGT
caaaggtcttgctgagtaat

SEQ ID NO: 22389 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ttctgaagatttccgagcag

SEQ ID NO: 22390 - DNA, 20 bp, Artificial Sequence
  Description of Artificial Sequence: Synthetic oligonucleotide
  Target: ATXN1; (+) strand; PAM type: NNGRRT; PAM sequence: GTGAGT
actatgtctactgcttctaa

SEQ ID NO: 22391 - DNA, 20 bp, Artificial Sequence
  Description of Artificial Sequence: Synthetic oligonucleotide
  Target: ATXN1; (+) strand; PAM type: NNGRRT; PAM sequence: CTGAAT
caagatgcagatctgttttt

SEQ ID NO: 22392 - DNA, 20 bp, Artificial Sequence
  Description of Artificial Sequence: Synthetic oligonucleotide
  Target: ATXN1; (+) strand; PAM type: NNGRRT; PAM sequence: ACGGGT
ctgtgattctagcagaagtt

SEQ ID NO: 22393 - DNA, 20 bp, Artificial Sequence
  Description of Artificial Sequence: Synthetic oligonucleotide
  Target: ATXN1; (+) strand; PAM type: NNGRRT; PAM sequence: TAGGAT
aagatgcacctgtgtgcgta

SEQ ID NO: 22394 - DNA, 20 bp, Artificial Sequence
  Description of Artificial Sequence: Synthetic oligonucleotide
  Target: ATXN1; (+) strand; PAM type: NNGRRT; PAM sequence: GTGGAT
gatggtggacgtgtgcatag

SEQ ID NO: 22395 - DNA, 20 bp, Artificial Sequence
  Description of Artificial Sequence: Synthetic oligonucleotide
  Target: ATXN1; (+) strand; PAM type: NNGRRT; PAM sequence: CAGAAT
acatgctctcaatgacaacc

SEQ ID NO: 22396 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctctagaaacaattaaagtc

SEQ ID NO: 22397 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aaacaattaaagtccagaat

SEQ ID NO: 22398 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ccttatgaagccatgtagtg

SEQ ID NO: 22399 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ctccaagatactcctttaac

SEQ ID NO: 22400 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cttcattcacacagtgtgtt

SEQ ID NO: 22401 - DNA, 20 bp, Artificial Sequence
  Description of Artificial Sequence: Synthetic oligonucleotide
  Target: ATXN1; (+) strand; PAM type: NNGRRT; PAM sequence: GTGGGT
agcaaaaattagaagtgtag

SEQ ID NO: 22402 - DNA, 20 bp, Artificial Sequence
  Description of Artificial Sequence: Synthetic oligonucleotide
  Target: ATXN1; (+) strand; PAM type: NNGRRT; PAM sequence: GGGGGT
tggccagaacattgccttac

SEQ ID NO: 22403 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tggctgggcctcttctgtct

SEQ ID NO: 22404 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gctccacgtatttccgatga

SEQ ID NO: 22405 - DNA, 20 bp, Artificial Sequence
  Description of Artificial Sequence: Synthetic oligonucleotide
  Target: ATXN1; (+) strand; PAM type: NNGRRT; PAM sequence: TTGGGT
agcataaagaaaactgtggt

SEQ ID NO: 22406 - DNA, 20 bp, Artificial Sequence
  Description of Artificial Sequence: Synthetic oligonucleotide
  Target: ATXN1; (+) strand; PAM type: NNGRRT; PAM sequence: CCGGGT
aaggtagatcttgctcctgt

SEQ ID NO: 22407 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tcctgcatggccttccaagt

SEQ ID NO: 22408 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gtgagggtcagttgtcactc

SEQ ID NO: 22409 - DNA, 20 bp, Artificial Sequence
  Description of Artificial Sequence: Synthetic oligonucleotide
  Target: ATXN1; (+) strand; PAM type: NNGRRT; PAM sequence: GTGGGT
taactataatgtagtgccat

SEQ ID NO: 22410 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gttgacagactgattgaaaa

SEQ ID NO: 22411 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgaaaatagaatccgtggtt

SEQ ID NO: 22412 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tgggactgaccatccctact

SEQ ID NO: 22413 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tcacgcccctaaatgagact

SEQ ID NO: 22414 - DNA, 20 bp, Artificial Sequence
  Description of Artificial Sequence: Synthetic oligonucleotide
  Target: ATXN1; (+) strand; PAM type: NNGRRT; PAM sequence: AGGGGT
aggcaaagcctaaagcattt

SEQ ID NO: 22415 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ttgaaggacagggcagcact

SEQ ID NO: 22416 - DNA, 20 bp, Artificial Sequence
  Description of Artificial Sequence: Synthetic oligonucleotide
  Target: ATXN1; (+) strand; PAM type: NNGRRT; PAM sequence: TGGAGT
actgtgagtctccattttca

SEQ ID NO: 22417 - DNA, 20 bp, Artificial Sequence
  Description of Artificial Sequence: Synthetic oligonucleotide
  Target: ATXN1; (+) strand; PAM type: NNGRRT; PAM sequence: TAGGAT
accataaattgtaagtagat

SEQ ID NO: 22418 - DNA, 20 bp, Artificial Sequence
  Description of Artificial Sequence: Synthetic oligonucleotide
  Target: ATXN1; (+) strand; PAM type: NNGRRT; PAM sequence: AAGAAT
taaaatgatcaactccacac

SEQ ID NO: 22419 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agcttttttattttttgaga

SEQ ID NO: 22420 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttggttcttgtcgcccaggc

SEQ ID NO: 22421 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aattctcctgcctcagcctc

SEQ ID NO: 22422 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtagaga

SEQ ID NO: 22423 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcagcgtcccaaagtgc

SEQ ID NO: 22424 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ttttgtatttttagtagaga

SEQ ID NO: 22425 - DNA, 20 bp, Artificial Sequence
  Description of Artificial Sequence: Synthetic oligonucleotide
  Target: ATXN1; (+) strand; PAM type: NNGRRT; PAM sequence: CAGGAT
catcgtgactatagtctgaa

SEQ ID NO: 22426 - DNA, 20 bp, Artificial Sequence
  Description of Artificial Sequence: Synthetic oligonucleotide
  Target: ATXN1; (+) strand; PAM type: NNGRRT; PAM sequence: ACGAGT
ctatagtctgaacaggatac

SEQ ID NO: 22427 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ggctcatctgtcctgtctca

SEQ ID NO: 22428 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ccatgctctactacagttcc

SEQ ID NO: 22429 - DNA, 20 bp, Artificial Sequence
  Description of Artificial Sequence: Synthetic oligonucleotide
  Target: ATXN1; (+) strand; PAM type: NNGRRT; PAM sequence: AGGGGT
aatagacacctctgcaggcc

SEQ ID NO: 22430 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gtgtgtgtgtctaaaaccaa

SEQ ID NO: 22431 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gcatcagtttccctaattta

SEQ ID NO: 22432 - DNA, 20 bp, Artificial Sequence
  Description of Artificial Sequence: Synthetic oligonucleotide
  Target: ATXN1; (+) strand; PAM type: NNGRRT; PAM sequence: TAGAGT
cctgtcctggtatttattac

SEQ ID NO: 22433 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tactagagtaatgtcaggtt

SEQ ID NO: 22434 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tctttaatggcaccatcaaa

SEQ ID NO: 22435 - DNA, 20 bp, Artificial Sequence
  Description of Artificial Sequence: Synthetic oligonucleotide
  Target: ATXN1; (+) strand; PAM type: NNGRRT; PAM sequence: GAGGAT
attaaaaataggaacaacat

SEQ ID NO: 22436 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ctgcataagagaaataaata

SEQ ID NO: 22437 - DNA, 20 bp, Artificial Sequence
  Description of Artificial Sequence: Synthetic oligonucleotide
  Target: ATXN1; (+) strand; PAM type: NNGRRT; PAM sequence: GAGAAT
attgaacaacttattaatta

SEQ ID NO: 22438 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ttattaattagagaattctg

SEQ ID NO: 22439 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctgtagggtaactgaaacaa

SEQ ID NO: 22440 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aacaaaaatataaaatgcct

SEQ ID NO: 22441 - DNA, 20 bp, Artificial Sequence
  Description of Artificial Sequence: Synthetic oligonucleotide
  Target: ATXN1; (+) strand; PAM type: NNGRRT; PAM sequence: CTGGGT
caagatctacataaagaggg

SEQ ID NO: 22442 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggcagatcacttgaggtc

SEQ ID NO: 22443 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tactggggaggctaaggcac

SEQ ID NO: 22444 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactttagcctgggaaa

SEQ ID NO: 22445 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaaacaaatctacataaag

SEQ ID NO: 22446 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tgcaaaggtctatcttcttc

SEQ ID NO: 22447 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gaatagaaagtcaatatcaa

SEQ ID NO: 22448 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctatggaaaaataaacagga

SEQ ID NO: 22449 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gatataaaaagaaataagaa

SEQ ID NO: 22450 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aaaacagtgtgcatgggcac

SEQ ID NO: 22451 - DNA, 20 bp, Artificial Sequence
  Description of Artificial Sequence: Synthetic oligonucleotide
  Target: ATXN1; (+) strand; PAM type: NNGRRT; PAM sequence: ATGAAT
cagaaaagaggtcgatccaa

SEQ ID NO: 22452 - DNA, 20 bp, Artificial Sequence
  Description of Artificial Sequence: Synthetic oligonucleotide
  Target: ATXN1; (+) strand; PAM type: NNGRRT; PAM sequence: GTGAAT
caaatgaatactggacttca

SEQ ID NO: 22453 - DNA, 20 bp, Artificial Sequence
  Description of Artificial Sequence: Synthetic oligonucleotide
  Target: ATXN1; (+) strand; PAM type: NNGRRT; PAM sequence: ATGGGT
actggacttcagtgaatgat

SEQ ID NO: 22454 - DNA, 20 bp, Artificial Sequence
  Description of Artificial Sequence: Synthetic oligonucleotide
  Target: ATXN1; (+) strand; PAM type: NNGRRT; PAM sequence: GTGGAT
agagataaaacatagattaa

SEQ ID NO: 22455 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ccagaaggtagaggaaatgg

SEQ ID NO: 22456 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aaggtagaggaaatggggga

SEQ ID NO: 22457 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aatgggggagtgggtgctta

SEQ ID NO: 22458 - DNA, 20 bp, Artificial Sequence
  Description of Artificial Sequence: Synthetic oligonucleotide
  Target: ATXN1; (+) strand; PAM type: NNGRRT; PAM sequence: TGGAGT
atgggtaaaggttttctttt

SEQ ID NO: 22459 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gatgatgattgtataattct

SEQ ID NO: 22460 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gcaggaggctgcttgagccc

SEQ ID NO: 22461 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctgcaccactgcactccagc

SEQ ID NO: 22462 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaaggtaagttttacgatat

SEQ ID NO: 22463 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tttttattttcttttagaga

SEQ ID NO: 22464 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcacccaggc

SEQ ID NO: 22465 - DNA, 20 bp, Artificial Sequence
  Description of Artificial Sequence: Synthetic oligonucleotide
  Target: ATXN1; (+) strand; PAM type: NNGRRT; PAM sequence: CCGAGT
aatccttccacctcagcctc

SEQ ID NO: 22466 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttattattattatgtaaaaa

SEQ ID NO: 22467 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gccttggcctcccaaagtgc

SEQ ID NO: 22468 - DNA, 20 bp, Artificial Sequence
  Description of Artificial Sequence: Synthetic oligonucleotide
  Target: ATXN1; (+) strand; PAM type: NNGRRT; PAM sequence: CAGGAT
taaaaaaaaaagtcaattca

SEQ ID NO: 22469 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gtagtagaaaaatgggcaac

SEQ ID NO: 22470 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tagaaaaatgggcaacgagg

SEQ ID NO: 22471 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gaaacccatattaaagctac

SEQ ID NO: 22472 - DNA, 20 bp, Artificial Sequence
  Description of Artificial Sequence: Synthetic oligonucleotide
  Target: ATXN1; (+) strand; PAM type: NNGRRT; PAM sequence: ACGAAT
tagcaggaacatacaatagg

SEQ ID NO: 22473 - DNA, 20 bp, Artificial Sequence
  Description of Artificial Sequence: Synthetic oligonucleotide
  Target: ATXN1; (+) strand; PAM type: NNGRRT; PAM sequence: GAGAGT
catacaacatgctatttata

SEQ ID NO: 22474 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aaaagtccatcaatgtggga

SEQ ID NO: 22475 - DNA, 20 bp, Artificial Sequence
  Description of Artificial Sequence: Synthetic oligonucleotide
  Target: ATXN1; (+) strand; PAM type: NNGRRT; PAM sequence: TCGAAT
tttatggcaaaatcatacaa

SEQ ID NO: 22476 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atactatttagatactaaaa

SEQ ID NO: 22477 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aggtgaaaagaggtaaaggg

SEQ ID NO: 22478 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gtaaagggcagaatagtgta

SEQ ID NO: 22479 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aatggtacttgcttctaggt

SEQ ID NO: 22480 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gcaaagtacgtggtctaatt

SEQ ID NO: 22481 - DNA, 20 bp, Artificial Sequence
  Description of Artificial Sequence: Synthetic oligonucleotide
  Target: ATXN1; (+) strand; PAM type: NNGRRT; PAM sequence: GTGGAT
gggaccacctccaagaccaa

SEQ ID NO: 22482 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gctggagatatgccaacgag

SEQ ID NO: 22483 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ggtttgtttagatttatcct

SEQ ID NO: 22484 - DNA, 20 bp, Artificial Sequence
  Description of Artificial Sequence: Synthetic oligonucleotide
  Target: ATXN1; (+) strand; PAM type: NNGRRT; PAM sequence: CTGAAT
attttacttattctgcgtag

SEQ ID NO: 22485 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gtcttccaatggtcatcagt

SEQ ID NO: 22486 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgggaggctgaggcag

SEQ ID NO: 22487 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tcacaccattgcactccagt

SEQ ID NO: 22488 - DNA, 20 bp, Artificial Sequence
  Description of Artificial Sequence: Synthetic oligonucleotide
  Target: ATXN1; (+) strand; PAM type: NNGRRT; PAM sequence: AGGGGT
atgcttgttctaaagggggc

SEQ ID NO: 22489 - DNA, 20 bp, Artificial Sequence
  Description of Artificial Sequence: Synthetic oligonucleotide
  Target: ATXN1; (+) strand; PAM type: NNGRRT; PAM sequence: TAGAAT
caggggtggagagagaagac

SEQ ID NO: 22490 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cccgtcttggaggaggttag

SEQ ID NO: 22491 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gaggaggttagaagagtgtt

SEQ ID NO: 22492 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gagattcttgtagcaaatcc

SEQ ID NO: 22493 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tgttcataggagaacaaaat

SEQ ID NO: 22494 - DNA, 20 bp, Artificial Sequence
  Description of Artificial Sequence: Synthetic oligonucleotide
  Target: ATXN1; (+) strand; PAM type: NNGRRT; PAM sequence: GGGAGT
atgtaattagtggagacaat

SEQ ID NO: 22495 - DNA, 20 bp, Artificial Sequence
  Description of Artificial Sequence: Synthetic oligonucleotide
  Target: ATXN1; (+) strand; PAM type: NNGRRT; PAM sequence: GTGAGT
aattagtggagacaatggga

SEQ ID NO: 22496 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctattgaaaaataaaataaa

SEQ ID NO: 22497 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgaccttcggaaaaatttct

SEQ ID NO: 22498 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ttctctgaatccctgatgcc

SEQ ID NO: 22499 - DNA, 20 bp, Artificial Sequence
  Description of Artificial Sequence: Synthetic oligonucleotide
  Target: ATXN1; (+) strand; PAM type: NNGRRT; PAM sequence: GAGGAT
atatctgatacaagagattg

SEQ ID NO: 22500 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tacaagagattggaggatcc

SEQ ID NO: 22501 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cattgctattttccaagctt

SEQ ID NO: 22502 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gataatatttttgcaattac

SEQ ID NO: 22503 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tatttactgtgtttaaggac

SEQ ID NO: 22504 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aattctcaatatactgtctc

SEQ ID NO: 22505 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ccaaaaaaaagataacttcc

SEQ ID NO: 22506 - DNA, 20 bp, Artificial Sequence
  Description of Artificial Sequence: Synthetic oligonucleotide
  Target: ATXN1; (+) strand; PAM type: NNGRRT; PAM sequence: CAGAAT
attatgtcataaggagaaca

SEQ ID NO: 22507 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aatttgatgtggtcctggaa

SEQ ID NO: 22508 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aatgcagagaggggaggcag

SEQ ID NO: 22509 - DNA, 20 bp, Artificial Sequence
  Description of Artificial Sequence: Synthetic oligonucleotide
  Target: ATXN1; (+) strand; PAM type: NNGRRT; PAM sequence: ATGAGT
atggggaagcctgggctgca

SEQ ID NO: 22510 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agtggttatacacacttagg

SEQ ID NO: 22511 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cttaggcagaatctactttt

SEQ ID NO: 22512 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aagaaatgatcagagcagta

SEQ ID NO: 22513 - DNA, 20 bp, Artificial Sequence
  Description of Artificial Sequence: Synthetic oligonucleotide
  Target: ATXN1; (+) strand; PAM type: NNGRRT; PAM sequence: AAGAGT
agagaaaataaaggcagata

SEQ ID NO: 22514 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggccgaggcag

SEQ ID NO: 22515 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gcaggcggattgcttgagct

SEQ ID NO: 22516 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aagaagaaagaagaaagaag

SEQ ID NO: 22517 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gaaatacagcccagaggtct

SEQ ID NO: 22518 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cagaggtctaggagtaacca

SEQ ID NO: 22519 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ctgaataaaagcttactagt

SEQ ID NO: 22520 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ggccgagaagtttccagtgc

SEQ ID NO: 22521 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aactggtgactaagacttca

SEQ ID NO: 22522 - DNA, 20 bp, Artificial Sequence
  Description of Artificial Sequence: Synthetic oligonucleotide
  Target: ATXN1; (+) strand; PAM type: NNGRRT; PAM sequence: CTGGAT
cttcagtgggtggtaataat

SEQ ID NO: 22523 - DNA, 20 bp, Artificial Sequence
  Description of Artificial Sequence: Synthetic oligonucleotide
  Target: ATXN1; (+) strand; PAM type: NNGRRT; PAM sequence: ATGAAT
agtgggtggtaataatctgg

SEQ ID NO: 22524 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaacatgttgaggttaaaga

SEQ ID NO: 22525 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tgacaaagcctcagagaagt

SEQ ID NO: 22526 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tcagagaagtcagggtagag

SEQ ID NO: 22527 - DNA, 20 bp, Artificial Sequence
  Description of Artificial Sequence: Synthetic oligonucleotide
  Target: ATXN1; (+) strand; PAM type: NNGRRT; PAM sequence: AGGGGT
agagagggatccagaaaacg

SEQ ID NO: 22528 - DNA, 20 bp, Artificial Sequence
  Description of Artificial Sequence: Synthetic oligonucleotide
  Target: ATXN1; (+) strand; PAM type: NNGRRT; PAM sequence: CGGAGT
cgaggggtcttggagccttg

SEQ ID NO: 22529 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gggaggtcttcttgctcctc

SEQ ID NO: 22530 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tgtgagacaggagcaacgga

SEQ ID NO: 22531 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gacagaattaaagggaaaaa

SEQ ID NO: 22532 - DNA, 20 bp, Artificial Sequence
  Description of Artificial Sequence: Synthetic oligonucleotide
  Target: ATXN1; (+) strand; PAM type: NNGRRT; PAM sequence: AAGGAT
taaagggaaaaagagagtag

SEQ ID NO: 22533 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gagagtagaaggattcatgc

SEQ ID NO: 22534 - DNA, 20 bp, Artificial Sequence
  Description of Artificial Sequence: Synthetic oligonucleotide
  Target: ATXN1; (+) strand; PAM type: NNGRRT; PAM sequence: ATGAAT
caagattttaaaaaagcaag

SEQ ID NO: 22535 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aaatggtcctctaccaaagt

SEQ ID NO: 22536 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tcctctaccaaagtgagggt

SEQ ID NO: 22537 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttgaagagactggaaaagtt

SEQ ID NO: 22538 - DNA, 20 bp, Artificial Sequence
  Description of Artificial Sequence: Synthetic oligonucleotide
  Target: ATXN1; (+) strand; PAM type: NNGRRT; PAM sequence: AAGAAT
actctcctcagattaacagt

SEQ ID NO: 22539 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tttacatcaggacccatcag

SEQ ID NO: 22540 - DNA, 20 bp, Artificial Sequence
  Description of Artificial Sequence: Synthetic oligonucleotide
  Target: ATXN1; (+) strand; PAM type: NNGRRT; PAM sequence: GGGGAT
taagcagctgtgcaggtgat

SEQ ID NO: 22541 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tgcaggtgatggggatcatg

SEQ ID NO: 22542 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tgcaggattggtgcctggaa

SEQ ID NO: 22543 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtctaggctggttagggggc

SEQ ID NO: 22544 - DNA, 20 bp, Artificial Sequence
  Description of Artificial Sequence: Synthetic oligonucleotide
  Target: ATXN1; (+) strand; PAM type: NNGRRT; PAM sequence: AAGAGT
agaaagtggctatagtgacc

SEQ ID NO: 22545 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ggctatagtgaccaagagtg

SEQ ID NO: 22546 - DNA, 20 bp, Artificial Sequence
  Description of Artificial Sequence: Synthetic oligonucleotide
  Target: ATXN1; (+) strand; PAM type: NNGRRT; PAM sequence: ATGAGT
atagtgaccaagagtggggg

SEQ ID NO: 22547 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ggctcacaataaggagacaa

SEQ ID NO: 22548 - DNA, 20 bp, Artificial Sequence
  Description of Artificial Sequence: Synthetic oligonucleotide
  Target: ATXN1; (+) strand; PAM type: NNGRRT; PAM sequence: GGGGGT
gaggaagagagggaaagcaa

SEQ ID NO: 22549 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gctatgcccagagagaacta

SEQ ID NO: 22550 - DNA, 20 bp, Artificial Sequence
  Description of Artificial Sequence: Synthetic oligonucleotide
  Target: ATXN1; (+) strand; PAM type: NNGRRT; PAM sequence: GGGGGT
atttagaaaggtccaagttg

SEQ ID NO: 22551 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aggtccaagttggggggtgt

SEQ ID NO: 22552 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttcaagttgatacacaggtc

SEQ ID NO: 22553 - DNA, 20 bp, Artificial Sequence
  Description of Artificial Sequence: Synthetic oligonucleotide
  Target: ATXN1; (+) strand; PAM type: NNGRRT; PAM sequence: AAGGGT
agcaactgcagggcagagag

SEQ ID NO: 22554 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gatttatattccttactttt

SEQ ID NO: 22555 - DNA, 20 bp, Artificial Sequence
  Description of Artificial Sequence: Synthetic oligonucleotide
  Target: ATXN1; (+) strand; PAM type: NNGRRT; PAM sequence: ACGAAT
gatacaattgggagaagctc

SEQ ID NO: 22556 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gagaagctcacgaatagaaa

SEQ ID NO: 22557 - DNA, 20 bp, Artificial Sequence
  Description of Artificial Sequence: Synthetic oligonucleotide
  Target: ATXN1; (+) strand; PAM type: NNGRRT; PAM sequence: TGGGAT
atttcaacaggtgtatgatc

SEQ ID NO: 22558 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gatctgggatcatatcatga

SEQ ID NO: 22559 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aacagacagcatggaccttg

SEQ ID NO: 22560 - DNA, 20 bp, Artificial Sequence
  Description of Artificial Sequence: Synthetic oligonucleotide
  Target: ATXN1; (+) strand; PAM type: NNGRRT; PAM sequence: CAGGAT
catggaccttgctgagtaaa

SEQ ID NO: 22561 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ccttgctgagtaaacaggat

SEQ ID NO: 22562 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cagctcttctaccttttcag

SEQ ID NO: 22563 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tcaagaaaaatcatttttgg

SEQ ID NO: 22564 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtctacacaaaaacttggaa

SEQ ID NO: 22565 - DNA, 20 bp, Artificial Sequence
  Description of Artificial Sequence: Synthetic oligonucleotide
  Target: ATXN1; (+) strand; PAM type: NNGRRT; PAM sequence: AAGAGT
agcactgttcataatagtga

SEQ ID NO: 22566 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaatgtccatcaactgataa

SEQ ID NO: 22567 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttattccatcataacaagaa

SEQ ID NO: 22568 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tgactgatgtatgctgaaat

SEQ ID NO: 22569 - DNA, 20 bp, Artificial Sequence
  Description of Artificial Sequence: Synthetic oligonucleotide
  Target: ATXN1; (+) strand; PAM type: NNGRRT; PAM sequence: TGGAAT
attgcatgattctatttata

SEQ ID NO: 22570 - DNA, 20 bp, Artificial Sequence
  Description of Artificial Sequence: Synthetic oligonucleotide
  Target: ATXN1; (+) strand; PAM type: NNGRRT; PAM sequence: GAGGGT
cttcgtggttgccaggagct

SEQ ID NO: 22571 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gttgccaggagctgagggta

SEQ ID NO: 22572 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aaaatgggaagtgattgctg

SEQ ID NO: 22573 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gaagtgattgctgatgggta

SEQ ID NO: 22574 - DNA, 20 bp, Artificial Sequence
  Description of Artificial Sequence: Synthetic oligonucleotide
  Target: ATXN1; (+) strand; PAM type: NNGRRT; PAM sequence: AGGGGT
atgggtatgggatttccttt

SEQ ID NO: 22575 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgcctcctgctccccatctc

SEQ ID NO: 22576 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aataaacaagactttcttcc

SEQ ID NO: 22577 - DNA, 20 bp, Artificial Sequence
  Description of Artificial Sequence: Synthetic oligonucleotide
  Target: ATXN1; (+) strand; PAM type: NNGRRT; PAM sequence: GAGGGT
caagactttcttccctgggt

SEQ ID NO: 22578 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tgggtgagggtcttgatagg

SEQ ID NO: 22579 - DNA, 20 bp, Artificial Sequence
  Description of Artificial Sequence: Synthetic oligonucleotide
  Target: ATXN1; (+) strand; PAM type: NNGRRT; PAM sequence: CGGAAT
gataggtagaatactgtaca

SEQ ID NO: 22580 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agaatactgtacacggaata

SEQ ID NO: 22581 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttcaagcagttccttgactt

SEQ ID NO: 22582 - DNA, 20 bp, Artificial Sequence
  Description of Artificial Sequence: Synthetic oligonucleotide
  Target: ATXN1; (+) strand; PAM type: NNGRRT; PAM sequence: GTGGAT
ttctcaggagacatttccag

SEQ ID NO: 22583 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctagtttgaagtttatgaaa

SEQ ID NO: 22584 - DNA, 20 bp, Artificial Sequence
  Description of Artificial Sequence: Synthetic oligonucleotide
  Target: ATXN1; (+) strand; PAM type: NNGRRT; PAM sequence: TGGAGT
aaagaataagggggctactc

SEQ ID NO: 22585 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gggggctactctggagtact

SEQ ID NO: 22586 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gcttctccacaccataagga

SEQ ID NO: 22587 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aacgttgaggttaaaaaaat

SEQ ID NO: 22588 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ccacatgaaccagaaggtct

SEQ ID NO: 22589 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctttgctatttgaacattcc

SEQ ID NO: 22590 - DNA, 20 bp, Artificial Sequence
  Description of Artificial Sequence: Synthetic oligonucleotide
  Target: ATXN1; (+) strand; PAM type: NNGRRT; PAM sequence: TAGGGT
aggtaaaccatgttaatatc

SEQ ID NO: 22591 - DNA, 20 bp, Artificial Sequence
  Description of Artificial Sequence: Synthetic oligonucleotide
  Target: ATXN1; (+) strand; PAM type: NNGRRT; PAM sequence: TGGAGT
taacaggttactatggtcaa

SEQ ID NO: 22592 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ggcaagtgtaaaatagccca

SEQ ID NO: 22593 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttggtatgtacaatctacaa

SEQ ID NO: 22594 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gaactgttaactgcatgact

SEQ ID NO: 22595 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tctggatggtagggggaggg

SEQ ID NO: 22596 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggtctcaaaaaagagagaaa

SEQ ID NO: 22597 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aagagagaaaaaggattttt

SEQ ID NO: 22598 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cagattataaaagatttacg

SEQ ID NO: 22599 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaagatttacgttgaataac

SEQ ID NO: 22600 - DNA, 20 bp, Artificial Sequence
  Description of Artificial Sequence: Synthetic oligonucleotide
  Target: ATXN1; (+) strand; PAM type: NNGRRT; PAM sequence: TTGGGT
atgccctattctgtttttgc

SEQ ID NO: 22601 - DNA, 20 bp, Artificial Sequence
  Description of Artificial Sequence: Synthetic oligonucleotide
  Target: ATXN1; (+) strand; PAM type: NNGRRT; PAM sequence: TAGGGT
cagtaccaccatgttttttg

SEQ ID NO: 22602 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tttgttggcattttacaact

SEQ ID NO: 22603 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gatcctcccgcctcagcctc

SEQ ID NO: 22604 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggccacggcgg

SEQ ID NO: 22605 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aaaattagccgggcatggtg

SEQ ID NO: 22606 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgggaggctgaggcag

SEQ ID NO: 22607 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ggctgaggcaggagaatcgc

SEQ ID NO: 22608 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactccagcctgggcaa

SEQ ID NO: 22609 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aacaaaaacattttgtagag

SEQ ID NO: 22610 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gattaaacataaaggtgatc

SEQ ID NO: 22611 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aatctatgaggacaatctgg

SEQ ID NO: 22612 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tggcatcaaagtctgagcct

SEQ ID NO: 22613 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctgagcctgtgagtgcaagt

SEQ ID NO: 22614 - DNA, 20 bp, Artificial Sequence
  Description of Artificial Sequence: Synthetic oligonucleotide
  Target: ATXN1; (+) strand; PAM type: NNGRRT; PAM sequence: AAGGGT
taaatgtttctttccactgc

SEQ ID NO: 22615 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tgagaaatttttacttgtat

SEQ ID NO: 22616 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctttacaatctaatgtcagc

SEQ ID NO: 22617 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taaaagcaaatataaaatcc

SEQ ID NO: 22618 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgtagaacacacacacaaaa

SEQ ID NO: 22619 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tgcaaagatatctgacaacc

SEQ ID NO: 22620 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aacccagagtaatactagaa

SEQ ID NO: 22621 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgcaaaagattttcatagcc

SEQ ID NO: 22622 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaatcactattccaattcgc

SEQ ID NO: 22623 - DNA, 20 bp, Artificial Sequence
  Description of Artificial Sequence: Synthetic oligonucleotide
  Target: ATXN1; (+) strand; PAM type: NNGRRT; PAM sequence: GGGAAT
atatttgaaacgctgccaaa

SEQ ID NO: 22624 - DNA, 20 bp, Artificial Sequence
  Description of Artificial Sequence: Synthetic oligonucleotide
  Target: ATXN1; (+) strand; PAM type: NNGRRT; PAM sequence: GAGAGT
aatgtttctccaaacataaa

SEQ ID NO: 22625 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gtacaggcagttctcaatgt

SEQ ID NO: 22626 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aggcagttctcaatgtatga

SEQ ID NO: 22627 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ggtgaagaaatcatgaggag

SEQ ID NO: 22628 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctggcaatcaaaggctaata

SEQ ID NO: 22629 - DNA, 20 bp, Artificial Sequence
  Description of Artificial Sequence: Synthetic oligonucleotide
  Target: ATXN1; (+) strand; PAM type: NNGRRT; PAM sequence: AGGAAT
cagatctaatcttgagagag

SEQ ID NO: 22630 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aatggggacatgaccaagct

SEQ ID NO: 22631 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aagctctgggtatacacaca

SEQ ID NO: 22632 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gaatgaaccatctgggagga

SEQ ID NO: 22633 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tgggaggactggataatttc

SEQ ID NO: 22634 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ccagctcctaagaagtgcag

SEQ ID NO: 22635 - DNA, 20 bp, Artificial Sequence
  Description of Artificial Sequence: Synthetic oligonucleotide
  Target: ATXN1; (+) strand; PAM type: NNGRRT; PAM sequence: CCGGGT
aagggactgtcagttcagac

SEQ ID NO: 22636 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cccgggtggtttaaaagatg

SEQ ID NO: 22637 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggccaaggtgg

SEQ ID NO: 22638 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggcggatcacctgaggtc

SEQ ID NO: 22639 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactggggaggctaagacag

SEQ ID NO: 22640 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactccagcctgggcga

SEQ ID NO: 22641 - DNA, 20 bp, Artificial Sequence
  Description of Artificial Sequence: Synthetic oligonucleotide
  Target: ATXN1; (+) strand; PAM type: NNGRRT; PAM sequence: CAGGGT
atataatgccctgcaaatta

SEQ ID NO: 22642 - DNA, 20 bp, Artificial Sequence
  Description of Artificial Sequence: Synthetic oligonucleotide
  Target: ATXN1; (+) strand; PAM type: NNGRRT; PAM sequence: TCGGGT
agggtactcatggccaaatc

SEQ ID NO: 22643 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ggccaaatctcgggtggggc

SEQ ID NO: 22644 - DNA, 20 bp, Artificial Sequence
  Description of Artificial Sequence: Synthetic oligonucleotide
  Target: ATXN1; (+) strand; PAM type: NNGRRT; PAM sequence: GGGAGT
atctcgggtggggctgggat

SEQ ID NO: 22645 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tgccaggtgcagaagatcct

SEQ ID NO: 22646 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ttagggtctcccaacactga

SEQ ID NO: 22647 - DNA, 20 bp, Artificial Sequence
  Description of Artificial Sequence: Synthetic oligonucleotide
  Target: ATXN1; (+) strand; PAM type: NNGRRT; PAM sequence: CTGGGT
agccttgcgatacaaggacc

SEQ ID NO: 22648 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gatacaaggaccctgggtca

SEQ ID NO: 22649 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ttctactgtgttccaccctg

SEQ ID NO: 22650 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tgtgttccaccctgaagagt

SEQ ID NO: 22651 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ctatttgggaaactgaagaa

SEQ ID NO: 22652 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aaactgaagaagtgaatgtg

SEQ ID NO: 22653 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gttgaatcactaatcttact

SEQ ID NO: 22654 - DNA, 20 bp, Artificial Sequence
  Description of Artificial Sequence: Synthetic oligonucleotide
  Target: ATXN1; (+) strand; PAM type: NNGRRT; PAM sequence: GTGAGT
atcttactttgagtgtcctt

SEQ ID NO: 22655 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ccttgtgagtcaacagggct

SEQ ID NO: 22656 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cttcatctataagtataatt

SEQ ID NO: 22657 - DNA, 20 bp, Artificial Sequence
  Description of Artificial Sequence: Synthetic oligonucleotide
  Target: ATXN1; (+) strand; PAM type: NNGRRT; PAM sequence: TAGGGT
caagtaggacccacgtagat

SEQ ID NO: 22658 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tgtattctgcctaagataac

SEQ ID NO: 22659 - DNA, 20 bp, Artificial Sequence
  Description of Artificial Sequence: Synthetic oligonucleotide
  Target: ATXN1; (+) strand; PAM type: NNGRRT; PAM sequence: GAGGGT
attttattcataagttgtta

SEQ ID NO: 22660 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agttaagatgtaatttgaaa

SEQ ID NO: 22661 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ttgcatctctagaaagatcc

SEQ ID NO: 22662 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tgcttcctgtgtggtggcct

SEQ ID NO: 22663 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aatccttatggagctctgtt

SEQ ID NO: 22664 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tctgttgagggttacacagc

SEQ ID NO: 22665 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctttaccttgcaattgctat

SEQ ID NO: 22666 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gaataaattcaaaatggttc

SEQ ID NO: 22667 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aaaacaagacagctattgta

SEQ ID NO: 22668 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctctactcatcaggcactct

SEQ ID NO: 22669 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aggtgacctggctggtatat

SEQ ID NO: 22670 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ttagtttaaaaggacataaa

SEQ ID NO: 22671 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ttccacagcaagcccataaa

SEQ ID NO: 22672 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ggaatctagaggctacttca

SEQ ID NO: 22673 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttattttatttttctagaga

SEQ ID NO: 22674 - DNA, 20 bp, Artificial Sequence
  Description of Artificial Sequence: Synthetic oligonucleotide
  Target: ATXN1; (+) strand; PAM type: NNGRRT; PAM sequence: TGGAGT
acttgttctgtcacccaggc

SEQ ID NO: 22675 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ttaaattttttttgtagaga

SEQ ID NO: 22676 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcagccccccaaagtgc

SEQ ID NO: 22677 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ccccaaagtgctgggattgc

SEQ ID NO: 22678 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tggccggttcctattccatg

SEQ ID NO: 22679 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttccacaatttcatattttt

SEQ ID NO: 22680 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cacttacaattaactataaa

SEQ ID NO: 22681 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tatgtctaagtcttccacag

SEQ ID NO: 22682 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ataaaaaaatatggttattc

SEQ ID NO: 22683 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gtgaaataagtgatgaaaac

SEQ ID NO: 22684 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aaaccctttcctacccaaca

SEQ ID NO: 22685 - DNA, 20 bp, Artificial Sequence
  Description of Artificial Sequence: Synthetic oligonucleotide
  Target: ATXN1; (+) strand; PAM type: NNGRRT; PAM sequence: CAGGGT
agccagccagagcatgactt

SEQ ID NO: 22686 - DNA, 20 bp, Artificial Sequence
  Description of Artificial Sequence: Synthetic oligonucleotide
  Target: ATXN1; (+) strand; PAM type: NNGRRT; PAM sequence: AAGAGT
agacatggtacctgaagatc

SEQ ID NO: 22687 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cacagcatcctctatcttgg

SEQ ID NO: 22688 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttggcagagttaagtggggc

SEQ ID NO: 22689 - DNA, 20 bp, Artificial Sequence
  Description of Artificial Sequence: Synthetic oligonucleotide
  Target: ATXN1; (+) strand; PAM type: NNGRRT; PAM sequence: TAGAAT
atgaatggccttttcctaag

SEQ ID NO: 22690 - DNA, 20 bp, Artificial Sequence
  Description of Artificial Sequence: Synthetic oligonucleotide
  Target: ATXN1; (+) strand; PAM type: NNGRRT; PAM sequence: CAGAGT
taagtagaatggtgatttaa

SEQ ID NO: 22691 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ggtgatttaacagagttttt

SEQ ID NO: 22692 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttcatggctactgctaggaa

SEQ ID NO: 22693 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tttaatcctccttcctcacc

SEQ ID NO: 22694 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgtaggcatgcaaatatctg

SEQ ID NO: 22695 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ggcatgcaaatatctgctga

SEQ ID NO: 22696 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttttatcccttcaaatacct

SEQ ID NO: 22697 - DNA, 20 bp, Artificial Sequence
  Description of Artificial Sequence: Synthetic oligonucleotide
  Target: ATXN1; (+) strand; PAM type: NNGRRT; PAM sequence: ACGAAT
catcctcccaacaccctcaa

SEQ ID NO: 22698 - DNA, 20 bp, Artificial Sequence
  Description of Artificial Sequence: Synthetic oligonucleotide
  Target: ATXN1; (+) strand; PAM type: NNGRRT; PAM sequence: ATGGAT
attctcagttgtctgttgtc

SEQ ID NO: 22699 - DNA, 20 bp, Artificial Sequence
  Description of Artificial Sequence: Synthetic oligonucleotide
  Target: ATXN1; (+) strand; PAM type: NNGRRT; PAM sequence: GTGGAT
ttgctctataattgcttcct

SEQ ID NO: 22700 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tgttttgttttgttttttga

SEQ ID NO: 22701 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcacccaggc

SEQ ID NO: 22702 - DNA, 20 bp, Artificial Sequence
  Description of Artificial Sequence: Synthetic oligonucleotide
  Target: ATXN1; (+) strand; PAM type: NNGRRT; PAM sequence: CCGGAT
cccaggctggagtgcagtgg

SEQ ID NO: 22703 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaagtagc

SEQ ID NO: 22704 - DNA, 20 bp, Artificial Sequence
  Description of Artificial Sequence: Synthetic oligonucleotide
  Target: ATXN1; (+) strand; PAM type: NNGRRT; PAM sequence: CGGAGT
atttatttatttatttgaga

SEQ ID NO: 22705 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ctcactgcaacctctgcctc

SEQ ID NO: 22706 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gcttctcctgcctcagcctc

SEQ ID NO: 22707 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcttgagtagc

SEQ ID NO: 22708 - DNA, 20 bp, Artificial Sequence
  Description of Artificial Sequence: Synthetic oligonucleotide
  Target: ATXN1; (+) strand; PAM type: NNGRRT; PAM sequence: CGGGGT
atttgtatttttagtagaaa

SEQ ID NO: 22709 - DNA, 20 bp, Artificial Sequence
  Description of Artificial Sequence: Synthetic oligonucleotide
  Target: ATXN1; (+) strand; PAM type: NNGRRT; PAM sequence: CAGGGT
cggggtttctccatgttgct

SEQ ID NO: 22710 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcggcctcccaaagtgt

SEQ ID NO: 22711 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtattttcagtagaga

SEQ ID NO: 22712 - DNA, 20 bp, Artificial Sequence
  Description of Artificial Sequence: Synthetic oligonucleotide
  Target: ATXN1; (+) strand; PAM type: NNGRRT; PAM sequence: CTGGGT
atcaaaactagaaagttaac

SEQ ID NO: 22713 - DNA, 20 bp, Artificial Sequence
  Description of Artificial Sequence: Synthetic oligonucleotide
  Target: ATXN1; (+) strand; PAM type: NNGRRT; PAM sequence: TAGGGT
cacgactactcaacaaaccg

SEQ ID NO: 22714 - DNA, 20 bp, Artificial Sequence
  Description of Artificial Sequence: Synthetic oligonucleotide
  Target: ATXN1; (+) strand; PAM type: NNGRRT; PAM sequence: TAGGAT
caacaaaccgtagggtgtat

SEQ ID NO: 22715 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tttttttttttttcctgttt

SEQ ID NO: 22716 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tcctgtttcaggatcatact

SEQ ID NO: 22717 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctgctaatctgtgacagttc

SEQ ID NO: 22718 - DNA, 20 bp, Artificial Sequence
  Description of Artificial Sequence: Synthetic oligonucleotide
  Target: ATXN1; (+) strand; PAM type: NNGRRT; PAM sequence: AGGGGT
accttgacaattttaagggg

SEQ ID NO: 22719 - DNA, 20 bp, Artificial Sequence
  Description of Artificial Sequence: Synthetic oligonucleotide
  Target: ATXN1; (+) strand; PAM type: NNGRRT; PAM sequence: TCGAAT
gggaggggtcagttattttt

SEQ ID NO: 22720 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tttttcgaatgtccttccat

SEQ ID NO: 22721 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tttgctatttttttcttgat

SEQ ID NO: 22722 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tgagattatgccttttcagg

SEQ ID NO: 22723 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tcagttaaggtgatgtctgc

SEQ ID NO: 22724 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ccttgtaattactaaatgtt

SEQ ID NO: 22725 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aattactaaatgtttggggt

SEQ ID NO: 22726 - DNA, 20 bp, Artificial Sequence
  Description of Artificial Sequence: Synthetic oligonucleotide
  Target: ATXN1; (+) strand; PAM type: NNGRRT; PAM sequence: ACGAAT
tagggatattttaaaattct

SEQ ID NO: 22727 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ttctcgtggcaattcttact

SEQ ID NO: 22728 - DNA, 20 bp, Artificial Sequence
  Description of Artificial Sequence: Synthetic oligonucleotide
  Target: ATXN1; (+) strand; PAM type: NNGRRT; PAM sequence: AAGAGT
actgaaattctgctgcaggg

SEQ ID NO: 22729 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ttatttattcattggactcg

SEQ ID NO: 22730 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ctcgttggatattttattct

SEQ ID NO: 22731 - DNA, 20 bp, Artificial Sequence
  Description of Artificial Sequence: Synthetic oligonucleotide
  Target: ATXN1; (+) strand; PAM type: NNGRRT; PAM sequence: GCGGGT
aagacaagaacaggcacaca

SEQ ID NO: 22732 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gagggccttgtgttaggtgt

SEQ ID NO: 22733 - DNA, 20 bp, Artificial Sequence
  Description of Artificial Sequence: Synthetic oligonucleotide
  Target: ATXN1; (+) strand; PAM type: NNGRRT; PAM sequence: CCGAGT
aaataaaacaattcctctgt

SEQ ID NO: 22734 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tcaactctacctggagaaaa

SEQ ID NO: 22735 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttagcaggtactccaagccc

SEQ ID NO: 22736 - DNA, 20 bp, Artificial Sequence
  Description of Artificial Sequence: Synthetic oligonucleotide
  Target: ATXN1; (+) strand; PAM type: NNGRRT; PAM sequence: GGGAAT
atcgtttttattccttcaca

SEQ ID NO: 22737 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ggaataatgaagagcaaata

SEQ ID NO: 22738 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tcagcccagcaaatgtcctc

SEQ ID NO: 22739 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacaagaactgcacacaata

SEQ ID NO: 22740 - DNA, 20 bp, Artificial Sequence
  Description of Artificial Sequence: Synthetic oligonucleotide
  Target: ATXN1; (+) strand; PAM type: NNGRRT; PAM sequence: AAGGAT
taactcctactattgttcta

SEQ ID NO: 22741 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tcctactattgttctaaagg

SEQ ID NO: 22742 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caatagtaaatactgccgaa

SEQ ID NO: 22743 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gcccaaatgtacacatattc

SEQ ID NO: 22744 - DNA, 20 bp, Artificial Sequence
  Description of Artificial Sequence: Synthetic oligonucleotide
  Target: ATXN1; (+) strand; PAM type: NNGRRT; PAM sequence: CAGAGT
caaataagctcttatgcaca

SEQ ID NO: 22745 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ggccccaccccgagcatgca

SEQ ID NO: 22746 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ctgcccagacctccctaaat

SEQ ID NO: 22747 - DNA, 20 bp, Artificial Sequence
  Description of Artificial Sequence: Synthetic oligonucleotide
  Target: ATXN1; (+) strand; PAM type: NNGRRT; PAM sequence: GAGGGT
cagccctttgggaggccgag

SEQ ID NO: 22748 - DNA, 20 bp, Artificial Sequence
  Description of Artificial Sequence: Synthetic oligonucleotide
  Target: ATXN1; (+) strand; PAM type: NNGRRT; PAM sequence: GTGGAT
cctttgggaggccgaggagg

SEQ ID NO: 22749 - DNA, 20 bp, Artificial Sequence
  Description of Artificial Sequence: Synthetic oligonucleotide
  Target: ATXN1; (+) strand; PAM type: NNGRRT; PAM sequence: AGGAGT
agggtggatcacctgaggcc

SEQ ID NO: 22750 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tacttgggaagctgaggcaa

SEQ ID NO: 22751 - DNA, 20 bp, Artificial Sequence
  Description of Artificial Sequence: Synthetic oligonucleotide
  Target: ATXN1; (+) strand; PAM type: NNGRRT; PAM sequence: GAGAGT
atgtggtttaccgcttaaca

SEQ ID NO: 22752 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aattctgttacagggcttac

SEQ ID NO: 22753 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gaaaaattctgtaaacatag

SEQ ID NO: 22754 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aagcagaaaaaataattcat

SEQ ID NO: 22755 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctccatgccataagaaattg

SEQ ID NO: 22756 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gcggaaaaaaccctcagatt

SEQ ID NO: 22757 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gcagaactgagattcaaaac

SEQ ID NO: 22758 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttaattttattacatttttc

SEQ ID NO: 22759 - DNA, 20 bp, Artificial Sequence
  Description of Artificial Sequence: Synthetic oligonucleotide
  Target: ATXN1; (+) strand; PAM type: NNGRRT; PAM sequence: TGGAAT
catctgctttctttattccc

SEQ ID NO: 22760 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gatatgatgttccattatct

SEQ ID NO: 22761 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gttccattatctgaggatct

SEQ ID NO: 22762 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aactgttgctgcacatattg

SEQ ID NO: 22763 - DNA, 20 bp, Artificial Sequence
  Description of Artificial Sequence: Synthetic oligonucleotide
  Target: ATXN1; (+) strand; PAM type: NNGRRT; PAM sequence: AAGAGT
accccattccagaaaatctg

SEQ ID NO: 22764 - DNA, 20 bp, Artificial Sequence
  Description of Artificial Sequence: Synthetic oligonucleotide
  Target: ATXN1; (+) strand; PAM type: NNGRRT; PAM sequence: TCGAAT
tactcaaccacatctacttc

SEQ ID NO: 22765 - DNA, 20 bp, Artificial Sequence
  Description of Artificial Sequence: Synthetic oligonucleotide
  Target: ATXN1; (+) strand; PAM type: NNGRRT; PAM sequence: TGGAAT
cactgttattcccaagatcc

SEQ ID NO: 22766 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aagatcctggaattaaacag

SEQ ID NO: 22767 - DNA, 20 bp, Artificial Sequence
  Description of Artificial Sequence: Synthetic oligonucleotide
  Target: ATXN1; (+) strand; PAM type: NNGRRT; PAM sequence: AAGGGT
atccttccagagccagccca

SEQ ID NO: 22768 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ttaacatcactccttctcag

SEQ ID NO: 22769 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tgccagcacagcctgataac

SEQ ID NO: 22770 - DNA, 20 bp, Artificial Sequence
  Description of Artificial Sequence: Synthetic oligonucleotide
  Target: ATXN1; (+) strand; PAM type: NNGRRT; PAM sequence: TGGGGT
attagataagcccccctttt

SEQ ID NO: 22771 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ccctttttggggtgtgtgta

SEQ ID NO: 22772 - DNA, 20 bp, Artificial Sequence
  Description of Artificial Sequence: Synthetic oligonucleotide
  Target: ATXN1; (+) strand; PAM type: NNGRRT; PAM sequence: TGGGAT
cactttccctgctgttttaa

SEQ ID NO: 22773 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ctgttttaatgggattattt

SEQ ID NO: 22774 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gtcatcgaaatactcattta

SEQ ID NO: 22775 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aaggggttaagcatctggaa

SEQ ID NO: 22776 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gggttgcctttgtgcatgaa

SEQ ID NO: 22777 - DNA, 20 bp, Artificial Sequence
  Description of Artificial Sequence: Synthetic oligonucleotide
  Target: ATXN1; (+) strand; PAM type: NNGRRT; PAM sequence: CAGGGT
agatggagaacttggaagca

SEQ ID NO: 22778 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aacttggaagcacagggtca

SEQ ID NO: 22779 - DNA, 20 bp, Artificial Sequence
  Description of Artificial Sequence: Synthetic oligonucleotide
  Target: ATXN1; (+) strand; PAM type: NNGRRT; PAM sequence: TTGAAT
caagtccaagggcgtttcac

SEQ ID NO: 22780 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aagggcgtttcacttgaatt

SEQ ID NO: 22781 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gctttatctgcagacacact

SEQ ID NO: 22782 - DNA, 20 bp, Artificial Sequence
  Description of Artificial Sequence: Synthetic oligonucleotide
  Target: ATXN1; (+) strand; PAM type: NNGRRT; PAM sequence: CTGAAT
taaagcacacggcatcagca

SEQ ID NO: 22783 - DNA, 20 bp, Artificial Sequence
  Description of Artificial Sequence: Synthetic oligonucleotide
  Target: ATXN1; (+) strand; PAM type: NNGRRT; PAM sequence: CAGGGT
atctccaccaggaaaaaata

SEQ ID NO: 22784 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttagagagagagagagagag

SEQ ID NO: 22785 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aacagttgtttcaacaatca

SEQ ID NO: 22786 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gttgtttcaacaatcagtga

SEQ ID NO: 22787 - DNA, 20 bp, Artificial Sequence
  Description of Artificial Sequence: Synthetic oligonucleotide
  Target: ATXN1; (+) strand; PAM type: NNGRRT; PAM sequence: TTGAGT
atattcagggagcacagatc

SEQ ID NO: 22788 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tgagttagggagaaagggaa

SEQ ID NO: 22789 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gttcattttctcttccaccg

SEQ ID NO: 22790 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agctctcctatctcacattc

SEQ ID NO: 22791 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tagtgatttgaaaagtacca

SEQ ID NO: 22792 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ttgataaagctgtatgaaag

SEQ ID NO: 22793 - DNA, 20 bp, Artificial Sequence
  Description of Artificial Sequence: Synthetic oligonucleotide
  Target: ATXN1; (+) strand; PAM type: NNGRRT; PAM sequence: TCGAGT
atgaaagttggatttctacc

SEQ ID NO: 22794 - DNA, 20 bp, Artificial Sequence
  Description of Artificial Sequence: Synthetic oligonucleotide
  Target: ATXN1; (+) strand; PAM type: NNGRRT; PAM sequence: TTGAGT
cctcgagttttgcccgcact

SEQ ID NO: 22795 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gtctgtgcagcagtctgctt

SEQ ID NO: 22796 - DNA, 20 bp, Artificial Sequence
  Description of Artificial Sequence: Synthetic oligonucleotide
  Target: ATXN1; (+) strand; PAM type: NNGRRT; PAM sequence: AAGAGT
accattttctaatgtgtttt

SEQ ID NO: 22797 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttaagagtaaacacagatga

SEQ ID NO: 22798 - DNA, 20 bp, Artificial Sequence
  Description of Artificial Sequence: Synthetic oligonucleotide
  Target: ATXN1; (+) strand; PAM type: NNGRRT; PAM sequence: GAGAGT
aatagtctaccttatttcat

SEQ ID NO: 22799 - DNA, 20 bp, Artificial Sequence
  Description of Artificial Sequence: Synthetic oligonucleotide
  Target: ATXN1; (+) strand; PAM type: NNGRRT; PAM sequence: GTGAAT
atgagagttattacaactat

SEQ ID NO: 22800 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tattatttataaaactttca

SEQ ID NO: 22801 - DNA, 20 bp, Artificial Sequence
  Description of Artificial Sequence: Synthetic oligonucleotide
  Target: ATXN1; (+) strand; PAM type: NNGRRT; PAM sequence: TTGAAT
atataaaacacaatatactc

SEQ ID NO: 22802 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgcctttacccaaactggct

SEQ ID NO: 22803 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ggctatctacagattgaagg

SEQ ID NO: 22804 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ttttaaatacttaatatcag

SEQ ID NO: 22805 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ttatgatatagatgtagtcg

SEQ ID NO: 22806 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tttttctttttgtgtttctg

SEQ ID NO: 22807 - DNA, 20 bp, Artificial Sequence
  Description of Artificial Sequence: Synthetic oligonucleotide
  Target: ATXN1; (+) strand; PAM type: NNGRRT; PAM sequence: CGGGGT
atttcctaagagctgagggg

SEQ ID NO: 22808 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cctaagagctgaggggcggg

SEQ ID NO: 22809 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ggggaaaagaccccatgttc

SEQ ID NO: 22810 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tgtgtgtgtgtgtgtgtgtg

SEQ ID NO: 22811 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tgtgtgtgtgtgtgtgctgg

SEQ ID NO: 22812 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tgtgtgtgctgggtgggtgt

SEQ ID NO: 22813 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gctgggtgggtgtgtggatg

SEQ ID NO: 22814 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gggtgtgtggatggggagta

SEQ ID NO: 22815 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttaaagaaagaagaaaacat

SEQ ID NO: 22816 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gaaagaagaaaacatctggg

SEQ ID NO: 22817 - DNA, 20 bp, Artificial Sequence
  Description of Artificial Sequence: Synthetic oligonucleotide
  Target: ATXN1; (+) strand; PAM type: NNGRRT; PAM sequence: GTGGAT
acatctgggtagagtacgtg

SEQ ID NO: 22818 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aagagagcagctgaccaggg

SEQ ID NO: 22819 - DNA, 20 bp, Artificial Sequence
  Description of Artificial Sequence: Synthetic oligonucleotide
  Target: ATXN1; (+) strand; PAM type: NNGRRT; PAM sequence: AGGAAT
agagaccactaaaagcaccc

SEQ ID NO: 22820 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ccacaatcccacaaacaatg

SEQ ID NO: 22821 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ccacaaacaatgctgagtgg

SEQ ID NO: 22822 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ttatgcatgtgcacaaaagg

SEQ ID NO: 22823 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aattaatctcactctctgag

SEQ ID NO: 22824 - DNA, 20 bp, Artificial Sequence
  Description of Artificial Sequence: Synthetic oligonucleotide
  Target: ATXN1; (+) strand; PAM type: NNGRRT; PAM sequence: GTGGGT
actctctgaggtgaattata

SEQ ID NO: 22825 - DNA, 20 bp, Artificial Sequence
  Description of Artificial Sequence: Synthetic oligonucleotide
  Target: ATXN1; (+) strand; PAM type: NNGRRT; PAM sequence: AAGGAT
atagtgggtaaagtaagaaa

SEQ ID NO: 22826 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ggtgcacctcgattcttcct

SEQ ID NO: 22827 - DNA, 20 bp, Artificial Sequence
  Description of Artificial Sequence: Synthetic oligonucleotide
  Target: ATXN1; (+) strand; PAM type: NNGRRT; PAM sequence: TAGAGT
ccatctttctaacatgtttg

SEQ ID NO: 22828 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gactcatttcacaatttctt

SEQ ID NO: 22829 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tttcacaatttcttaaggat

SEQ ID NO: 22830 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tacattacctaaattgagag

SEQ ID NO: 22831 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ccctagcaactgtgcattcg

SEQ ID NO: 22832 - DNA, 20 bp, Artificial Sequence
  Description of Artificial Sequence: Synthetic oligonucleotide
  Target: ATXN1; (+) strand; PAM type: NNGRRT; PAM sequence: TAGAAT
atgcacctcttgcctccttt

SEQ ID NO: 22833 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ggcctttgctaaattaataa

SEQ ID NO: 22834 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gctaaattaataaatgagtg

SEQ ID NO: 22835 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aataaatgagtgaggaatga

SEQ ID NO: 22836 - DNA, 20 bp, Artificial Sequence
  Description of Artificial Sequence: Synthetic oligonucleotide
  Target: ATXN1; (+) strand; PAM type: NNGRRT; PAM sequence: TGGGAT
atgagtgaggaatgactgaa

SEQ ID NO: 22837 - DNA, 20 bp, Artificial Sequence
  Description of Artificial Sequence: Synthetic oligonucleotide
  Target: ATXN1; (+) strand; PAM type: NNGRRT; PAM sequence: ATGAAT
cttgcagataggtcttgtac

SEQ ID NO: 22838 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cagccagtgatccacagcaa

SEQ ID NO: 22839 - DNA, 20 bp, Artificial Sequence
  Description of Artificial Sequence: Synthetic oligonucleotide
  Target: ATXN1; (+) strand; PAM type: NNGRRT; PAM sequence: CTGAGT
agagaatcctttcttcctct

SEQ ID NO: 22840 - DNA, 20 bp, Artificial Sequence
  Description of Artificial Sequence: Synthetic oligonucleotide
  Target: ATXN1; (+) strand; PAM type: NNGRRT; PAM sequence: CAGAAT
acactcatgaggtgcctcat

SEQ ID NO: 22841 - DNA, 20 bp, Artificial Sequence
  Description of Artificial Sequence: Synthetic oligonucleotide
  Target: ATXN1; (+) strand; PAM type: NNGRRT; PAM sequence: GGGAAT
attcatcctcatagtcacag

SEQ ID NO: 22842 - DNA, 20 bp, Artificial Sequence
  Description of Artificial Sequence: Synthetic oligonucleotide
  Target: ATXN1; (+) strand; PAM type: NNGRRT; PAM sequence: AGGAAT
taagctaacatgtcttaatt

SEQ ID NO: 22843 - DNA, 20 bp, Artificial Sequence
  Description of Artificial Sequence: Synthetic oligonucleotide
  Target: ATXN1; (+) strand; PAM type: NNGRRT; PAM sequence: ACGAAT
gaccagaaattagggccaaa

SEQ ID NO: 22844 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ctacatacacaagctcatag

SEQ ID NO: 22845 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tcaacgttacgatggagcca

SEQ ID NO: 22846 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ccttccccttcatgcatctg

SEQ ID NO: 22847 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aagcatgcgtttcctaagag

SEQ ID NO: 22848 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ctaagagctgggtgtggcgg

SEQ ID NO: 22849 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tctcacccaacggctgctcc

SEQ ID NO: 22850 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gtttcaaagctctgtgaaaa

SEQ ID NO: 22851 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tgggtctctgacttgaaaac

SEQ ID NO: 22852 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tcaggaagtctctccaggac

SEQ ID NO: 22853 - DNA, 20 bp, Artificial Sequence
  Description of Artificial Sequence: Synthetic oligonucleotide
  Target: ATXN1; (+) strand; PAM type: NNGRRT; PAM sequence: GAGGAT
cctttttgtagatactagag

SEQ ID NO: 22854 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gcaaagtaattttggaagat

SEQ ID NO: 22855 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgattaaatactcctgaaat

SEQ ID NO: 22856 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tgcagcaacacccaagggag

SEQ ID NO: 22857 - DNA, 20 bp, Artificial Sequence
  Description of Artificial Sequence: Synthetic oligonucleotide
  Target: ATXN1; (+) strand; PAM type: NNGRRT; PAM sequence: CCGAAT
gagaagggtactattattat

SEQ ID NO: 22858 - DNA, 20 bp, Artificial Sequence
  Description of Artificial Sequence: Synthetic oligonucleotide
  Target: ATXN1; (+) strand; PAM type: NNGRRT; PAM sequence: TGGAAT
cttcaagaaaacagcagagc

SEQ ID NO: 22859 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ctaggacccttctactcctt

SEQ ID NO: 22860 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gtcgaaatctggtaagtttc

SEQ ID NO: 22861 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gggaactaatacagagctat

SEQ ID NO: 22862 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcatgaaagcaataaaatgt

SEQ ID NO: 22863 - DNA, 20 bp, Artificial Sequence
  Description of Artificial Sequence: Synthetic oligonucleotide
  Target: ATXN1; (+) strand; PAM type: NNGRRT; PAM sequence: GTGGAT
caataaaatgtctgggtgtg

SEQ ID NO: 22864 - DNA, 20 bp, Artificial Sequence
  Description of Artificial Sequence: Synthetic oligonucleotide
  Target: ATXN1; (+) strand; PAM type: NNGRRT; PAM sequence: ACGAGT
tgggaagactgcttgaggtc

SEQ ID NO: 22865 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tacttgggaggctgaggtgg

SEQ ID NO: 22866 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcatgccactgcactccagc

SEQ ID NO: 22867 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcactccagcctgggtga

SEQ ID NO: 22868 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cggctaactgtccagttaga

SEQ ID NO: 22869 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gatataaattaaataaattt

SEQ ID NO: 22870 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctgttgctatgaaagatgtt

SEQ ID NO: 22871 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tttgatgtttgtctctctaa

SEQ ID NO: 22872 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tataaatttataaatgcctt

SEQ ID NO: 22873 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ttcctttcccataaaaaagc

SEQ ID NO: 22874 - DNA, 20 bp, Artificial Sequence
  Description of Artificial Sequence: Synthetic oligonucleotide
  Target: ATXN1; (+) strand; PAM type: NNGRRT; PAM sequence: TGGAGT
aaagagacagtaggaaaaaa

SEQ ID NO: 22875 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taggaaaaaatggagtctac

SEQ ID NO: 22876 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tcttttcacgaagattttgc

SEQ ID NO: 22877 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gaagattttgcttgagtaga

SEQ ID NO: 22878 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gagtagaaagggtggcagtg

SEQ ID NO: 22879 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ttataaaaacaatattctca

SEQ ID NO: 22880 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cacacacaaggtttttaaat

SEQ ID NO: 22881 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cacagcaggtccctatcccc

SEQ ID NO: 22882 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gcaggtccctatccccaggg

SEQ ID NO: 22883 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gtccctatccccagggatga

SEQ ID NO: 22884 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gggatgagtgggttctggcc

SEQ ID NO: 22885 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agaaaatgtcagaaacattg

SEQ ID NO: 22886 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctgcagtctgtgaggtggcc

SEQ ID NO: 22887 - DNA, 20 bp, Artificial Sequence
  Description of Artificial Sequence: Synthetic oligonucleotide
  Target: ATXN1; (+) strand; PAM type: NNGRRT; PAM sequence: ACGGAT
actgacagtaaatacagcca

SEQ ID NO: 22888 - DNA, 20 bp, Artificial Sequence
  Description of Artificial Sequence: Synthetic oligonucleotide
  Target: ATXN1; (+) strand; PAM type: NNGRRT; PAM sequence: TAGGAT
cagttcacagaggtcatgct

SEQ ID NO: 22889 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggctgaggtgg

SEQ ID NO: 22890 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaagctgaggcag

SEQ ID NO: 22891 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gaatcacttgaaccggaagg

SEQ ID NO: 22892 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ctatcacctcatttttccca

SEQ ID NO: 22893 - DNA, 20 bp, Artificial Sequence
  Description of Artificial Sequence: Synthetic oligonucleotide
  Target: ATXN1; (+) strand; PAM type: NNGRRT; PAM sequence: TTGGAT
taaaattactattatttgtt

SEQ ID NO: 22894 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ccgacatgttcatatttcaa

SEQ ID NO: 22895 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gataacatcaaaaggcatat

SEQ ID NO: 22896 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aaagatatgaaaatgaagag

SEQ ID NO: 22897 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ctacatactaatacagatct

SEQ ID NO: 22898 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tagaatcactgcaacacaaa

SEQ ID NO: 22899 - DNA, 20 bp, Artificial Sequence
  Description of Artificial Sequence: Synthetic oligonucleotide
  Target: ATXN1; (+) strand; PAM type: NNGRRT; PAM sequence: ATGGGT
agaaatcaacaaaattatgt

SEQ ID NO: 22900 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actttggggggccaaggcgg

SEQ ID NO: 22901 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggaggatcacctgaggtc

SEQ ID NO: 22902 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gacccgggaggctgaggcag

SEQ ID NO: 22903 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atgttttctggaaatctaag

SEQ ID NO: 22904 - DNA, 20 bp, Artificial Sequence
  Description of Artificial Sequence: Synthetic oligonucleotide
  Target: ATXN1; (+) strand; PAM type: NNGRRT; PAM sequence: TAGAAT
cctcctaggacacacttgta

SEQ ID NO: 22905 - DNA, 20 bp, Artificial Sequence
  Description of Artificial Sequence: Synthetic oligonucleotide
  Target: ATXN1; (+) strand; PAM type: NNGRRT; PAM sequence: ACGAAT
attaatgcttgttttccccc

SEQ ID NO: 22906 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ctcacccctcctttcatctt

SEQ ID NO: 22907 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tgggcactcaataaaatctt

SEQ ID NO: 22908 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cactcaataaaatcttctga

SEQ ID NO: 22909 - DNA, 20 bp, Artificial Sequence
  Description of Artificial Sequence: Synthetic oligonucleotide
  Target: ATXN1; (+) strand; PAM type: NNGRRT; PAM sequence: TTGGAT
actgatttaattagtgttga

SEQ ID NO: 22910 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gtaaatcgttttccagcaca

SEQ ID NO: 22911 - DNA, 20 bp, Artificial Sequence
  Description of Artificial Sequence: Synthetic oligonucleotide
  Target: ATXN1; (+) strand; PAM type: NNGRRT; PAM sequence: TTGGGT
agtatgacatctacattcct

SEQ ID NO: 22912 - DNA, 20 bp, Artificial Sequence
  Description of Artificial Sequence: Synthetic oligonucleotide
  Target: ATXN1; (+) strand; PAM type: NNGRRT; PAM sequence: CCGGGT
tgagctctgaccccagccag

SEQ ID NO: 22913 - DNA, 20 bp, Artificial Sequence
  Description of Artificial Sequence: Synthetic oligonucleotide
  Target: ATXN1; (+) strand; PAM type: NNGRRT; PAM sequence: CAGAGT
atcccctcatcatagtaccc

SEQ ID NO: 22914 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tctgaaatatacgattaata

SEQ ID NO: 22915 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ggctaataacacctacctca

SEQ ID NO: 22916 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ctacctcacagggttgttac

SEQ ID NO: 22917 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtattgttagggcaactaag

SEQ ID NO: 22918 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ctaagctgaatttacaactt

SEQ ID NO: 22919 - DNA, 20 bp, Artificial Sequence
  Description of Artificial Sequence: Synthetic oligonucleotide
  Target: ATXN1; (+) strand; PAM type: NNGRRT; PAM sequence: AAGGAT
agaaaggagctcagaaaatt

SEQ ID NO: 22920 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tcagaaaattaaggataaag

SEQ ID NO: 22921 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cacttctgttaattactgga

SEQ ID NO: 22922 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tgacttcataaataaatact

SEQ ID NO: 22923 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaatactaaggatttgacta

SEQ ID NO: 22924 - DNA, 20 bp, Artificial Sequence
  Description of Artificial Sequence: Synthetic oligonucleotide
  Target: ATXN1; (+) strand; PAM type: NNGRRT; PAM sequence: CTGAAT
atgaatatgccataaaatgt

SEQ ID NO: 22925 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tattagatgctattctaatt

SEQ ID NO: 22926 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atgcactttggaaaaaaaat

SEQ ID NO: 22927 - DNA, 20 bp, Artificial Sequence
  Description of Artificial Sequence: Synthetic oligonucleotide
  Target: ATXN1; (+) strand; PAM type: NNGRRT; PAM sequence: ATGAAT
actttggaaaaaaaataaga

SEQ ID NO: 22928 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gctaccagtacatagttgaa

SEQ ID NO: 22929 - DNA, 20 bp, Artificial Sequence
  Description of Artificial Sequence: Synthetic oligonucleotide
  Target: ATXN1; (+) strand; PAM type: NNGRRT; PAM sequence: TAGAGT
caaatttaaataatgcatat

SEQ ID NO: 22930 - DNA, 20 bp, Artificial Sequence
  Description of Artificial Sequence: Synthetic oligonucleotide
  Target: ATXN1; (+) strand; PAM type: NNGRRT; PAM sequence: TAGAGT
aggcttttcctcagagatac

SEQ ID NO: 22931 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtttcccaggt

SEQ ID NO: 22932 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ggtcctctcacctcagcctc

SEQ ID NO: 22933 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttcactcctgttgcccaggc

SEQ ID NO: 22934 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aattatcctgcctcagcctc

SEQ ID NO: 22935 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcctgagtagc

SEQ ID NO: 22936 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtagaga

SEQ ID NO: 22937 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tggggtttctccatgttggc

SEQ ID NO: 22938 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttttaattttttagtagaga

SEQ ID NO: 22939 - DNA, 20 bp, Artificial Sequence
  Description of Artificial Sequence: Synthetic oligonucleotide
  Target: ATXN1; (+) strand; PAM type: NNGRRT; PAM sequence: TTGAAT
actattaaactccttttaaa

SEQ ID NO: 22940 - DNA, 20 bp, Artificial Sequence
  Description of Artificial Sequence: Synthetic oligonucleotide
  Target: ATXN1; (+) strand; PAM type: NNGRRT; PAM sequence: TAGAAT
acataattaaaatgagaagg

SEQ ID NO: 22941 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gtttgcgtcataacatctga

SEQ ID NO: 22942 - DNA, 20 bp, Artificial Sequence
  Description of Artificial Sequence: Synthetic oligonucleotide
  Target: ATXN1; (+) strand; PAM type: NNGRRT; PAM sequence: AGGGAT
attatgctggtccttcaatc

SEQ ID NO: 22943 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aaactgcacaattctttgca

SEQ ID NO: 22944 - DNA, 20 bp, Artificial Sequence
  Description of Artificial Sequence: Synthetic oligonucleotide
  Target: ATXN1; (+) strand; PAM type: NNGRRT; PAM sequence: GTGGGT
agtaaacactggtttgatgt

SEQ ID NO: 22945 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aacactggtttgatgtgtgg

SEQ ID NO: 22946 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgctgcgcattttcctgtct

SEQ ID NO: 22947 - DNA, 20 bp, Artificial Sequence
  Description of Artificial Sequence: Synthetic oligonucleotide
  Target: ATXN1; (+) strand; PAM type: NNGRRT; PAM sequence: CTGGGT
accaaattccccaggggccc

SEQ ID NO: 22948 - DNA, 20 bp, Artificial Sequence
  Description of Artificial Sequence: Synthetic oligonucleotide
  Target: ATXN1; (+) strand; PAM type: NNGRRT; PAM sequence: CGGAGT
gcactcatttaatggaaatc

SEQ ID NO: 22949 - DNA, 20 bp, Artificial Sequence
  Description of Artificial Sequence: Synthetic oligonucleotide
  Target: ATXN1; (+) strand; PAM type: NNGRRT; PAM sequence: CAGAAT
attattctgctcagctgttt

SEQ ID NO: 22950 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tggccagcacttcagtgatg

SEQ ID NO: 22951 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gatgatgaatccgagcagca

SEQ ID NO: 22952 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tattagtcactgttgggaca

SEQ ID NO: 22953 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tcactgttgggacaatgaat

SEQ ID NO: 22954 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ggtgatcaagcctttacttg

SEQ ID NO: 22955 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ctcctagctgattctgtgtc

SEQ ID NO: 22956 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tctggagttggttccttctg

SEQ ID NO: 22957 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttcgtggtctcgctgacttc

SEQ ID NO: 22958 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cagcagcaagatttatcata

SEQ ID NO: 22959 - DNA, 20 bp, Artificial Sequence
  Description of Artificial Sequence: Synthetic oligonucleotide
  Target: ATXN1; (+) strand; PAM type: NNGRRT; PAM sequence: AAGAAT
caaagcttccacagctggaa

SEQ ID NO: 22960 - DNA, 20 bp, Artificial Sequence
  Description of Artificial Sequence: Synthetic oligonucleotide
  Target: ATXN1; (+) strand; PAM type: NNGRRT; PAM sequence: GCGGGT
aggttgcactggtggctggt

SEQ ID NO: 22961 - DNA, 20 bp, Artificial Sequence
  Description of Artificial Sequence: Synthetic oligonucleotide
  Target: ATXN1; (+) strand; PAM type: NNGRRT; PAM sequence: GGGGGT
cactggtggctggtgcgggt

SEQ ID NO: 22962 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ggctggtgcgggtgggggtg

SEQ ID NO: 22963 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctccctggggactatggaaa

SEQ ID NO: 22964 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gcaatgtttgtaacccacaa

SEQ ID NO: 22965 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gtacgtaacctgtgaagcat

SEQ ID NO: 22966 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tatttgagaactagacattt

SEQ ID NO: 22967 - DNA, 20 bp, Artificial Sequence
  Description of Artificial Sequence: Synthetic oligonucleotide
  Target: ATXN1; (+) strand; PAM type: NNGRRT; PAM sequence: AGGGGT
catcctcctgccttctctcc

SEQ ID NO: 22968 - DNA, 20 bp, Artificial Sequence
  Description of Artificial Sequence: Synthetic oligonucleotide
  Target: ATXN1; (+) strand; PAM type: NNGRRT; PAM sequence: AGGGAT
actaatatatattagtctac

SEQ ID NO: 22969 - DNA, 20 bp, Artificial Sequence
  Description of Artificial Sequence: Synthetic oligonucleotide
  Target: ATXN1; (+) strand; PAM type: NNGRRT; PAM sequence: CTGGGT
acccatcagcataagtttcc

SEQ ID NO: 22970 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtttccctgggttattgcct

SEQ ID NO: 22971 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ccctgggttattgcctagga

SEQ ID NO: 22972 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tattgcctaggaatgggtct

SEQ ID NO: 22973 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttaaaactgataaatcattt

SEQ ID NO: 22974 - DNA, 20 bp, Artificial Sequence
  Description of Artificial Sequence: Synthetic oligonucleotide
  Target: ATXN1; (+) strand; PAM type: NNGRRT; PAM sequence: CGGAGT
tatttatttattttttgaga

SEQ ID NO: 22975 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gtctcattctgtcgccaggc

SEQ ID NO: 22976 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcactacagcctccacctc

SEQ ID NO: 22977 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gattctcctgcctcagcctc

SEQ ID NO: 22978 - DNA, 20 bp, Artificial Sequence
  Description of Artificial Sequence: Synthetic oligonucleotide
  Target: ATXN1; (+) strand; PAM type: NNGRRT; PAM sequence: CTGGAT
actatgttggccaggacggt

SEQ ID NO: 22979 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcggcctcccaaagtgc

SEQ ID NO: 22980 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tgtccctgtctctcacattg

SEQ ID NO: 22981 - DNA, 20 bp, Artificial Sequence
  Description of Artificial Sequence: Synthetic oligonucleotide
  Target: ATXN1; (+) strand; PAM type: NNGRRT; PAM sequence: GAGAGT
cagcactaagcataacaaac

SEQ ID NO: 22982 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ctaatgacttagattggact

SEQ ID NO: 22983 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tcattcaattcttaagcaag

SEQ ID NO: 22984 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aatgattctttcctctccaa

SEQ ID NO: 22985 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aaacctttggtcctggctca

SEQ ID NO: 22986 - DNA, 20 bp, Artificial Sequence
  Description of Artificial Sequence: Synthetic oligonucleotide
  Target: ATXN1; (+) strand; PAM type: NNGRRT; PAM sequence: ACGAAT
cctggctcaaagggtgagct

SEQ ID NO: 22987 - DNA, 20 bp, Artificial Sequence
  Description of Artificial Sequence: Synthetic oligonucleotide
  Target: ATXN1; (+) strand; PAM type: NNGRRT; PAM sequence: ATGAGT
acctatagatctgtctgggc

SEQ ID NO: 22988 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gatctgtctgggcatgagta

SEQ ID NO: 22989 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gagtacagaattggcaaata

SEQ ID NO: 22990 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agagacaacgataaaacgga

SEQ ID NO: 22991 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caggcagtgaggggagaggg

SEQ ID NO: 22992 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gagagactttcacctgtacg

SEQ ID NO: 22993 - DNA, 20 bp, Artificial Sequence
  Description of Artificial Sequence: Synthetic oligonucleotide
  Target: ATXN1; (+) strand; PAM type: NNGRRT; PAM sequence: CGGAAT
cgaaggatgtctctggaaaa

SEQ ID NO: 22994 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tggaaaacggaatgttgaca

SEQ ID NO: 22995 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtttttttatttttcagaga

SEQ ID NO: 22996 - DNA, 20 bp, Artificial Sequence
  Description of Artificial Sequence: Synthetic oligonucleotide
  Target: ATXN1; (+) strand; PAM type: NNGRRT; PAM sequence: CTGGAT
catcttggcctcccaaagtg

SEQ ID NO: 22997 - DNA, 20 bp, Artificial Sequence
  Description of Artificial Sequence: Synthetic oligonucleotide
  Target: ATXN1; (+) strand; PAM type: NNGRRT; PAM sequence: TCGGGT
gctgatttgcatatctaaaa

SEQ ID NO: 22998 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tgcatatctaaaatcgggtg

SEQ ID NO: 22999 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tctttgatttaaaaatgact

SEQ ID NO: 23000 - DNA, 20 bp, Artificial Sequence
  Description of Artificial Sequence: Synthetic oligonucleotide
  Target: ATXN1; (+) strand; PAM type: NNGRRT; PAM sequence: CAGAAT
attcctctgggaaatgaggt

SEQ ID NO: 23001 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gagccctttccaaaggcaag

SEQ ID NO: 23002 - DNA, 20 bp, Artificial Sequence
  Description of Artificial Sequence: Synthetic oligonucleotide
  Target: ATXN1; (+) strand; PAM type: NNGRRT; PAM sequence: ACGAAT
acaagctgaagcacacaccc

SEQ ID NO: 23003 - DNA, 20 bp, Artificial Sequence
  Description of Artificial Sequence: Synthetic oligonucleotide
  Target: ATXN1; (+) strand; PAM type: NNGRRT; PAM sequence: TTGGGT
acagccttcctgctccctga

SEQ ID NO: 23004 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gtgcactcacctgcagggcg

SEQ ID NO: 23005 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tctgcatcatgcactcagag

SEQ ID NO: 23006 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cagaggggagtgccactgct

SEQ ID NO: 23007 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ggctctgccgcagcctccca

SEQ ID NO: 23008 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aacacctccggtggaaggag

SEQ ID NO: 23009 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aagggaacctcgtcagccgc

SEQ ID NO: 23010 - DNA, 20 bp, Artificial Sequence
  Description of Artificial Sequence: Synthetic oligonucleotide
  Target: ATXN1; (+) strand; PAM type: NNGRRT; PAM sequence: CGGGGT
tcgtcagccgcaagaatctc

SEQ ID NO: 23011 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aatgctgcttcacatgttcg

SEQ ID NO: 23012 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gaagaatgcctcacatggtt

SEQ ID NO: 23013 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttttttttttttttttgaga

SEQ ID NO: 23014 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tcttgctctgtcacccaggc

SEQ ID NO: 23015 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttttgtattttcagtcgaga

SEQ ID NO: 23016 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcggcctcccaaggtgc

SEQ ID NO: 23017 - DNA, 20 bp, Artificial Sequence
  Description of Artificial Sequence: Synthetic oligonucleotide
  Target: ATXN1; (+) strand; PAM type: NNGRRT; PAM sequence: AGGAGT
taaagttttattaggagacc

SEQ ID NO: 23018 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gggacagcaaagaaaggcag

SEQ ID NO: 23019 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ggaaggagaagccaacagtc

SEQ ID NO: 23020 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gatttaaaaaaaaaaagaag

SEQ ID NO: 23021 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aagaagctgagtctgccatt

SEQ ID NO: 23022 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aatgataaactggtgaggtg

SEQ ID NO: 23023 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gaatatattaactagcttga

SEQ ID NO: 23024 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gtgaagacattttttaaaaa

SEQ ID NO: 23025 - DNA, 20 bp, Artificial Sequence
  Description of Artificial Sequence: Synthetic oligonucleotide
  Target: ATXN1; (+) strand; PAM type: NNGRRT; PAM sequence: ACGGGT
gcttgtcacaacctgccgga

SEQ ID NO: 23026 - DNA, 20 bp, Artificial Sequence
  Description of Artificial Sequence: Synthetic oligonucleotide
  Target: ATXN1; (+) strand; PAM type: NNGRRT; PAM sequence: AAGAGT
atacctgaaactccataatt

SEQ ID NO: 23027 - DNA, 20 bp, Artificial Sequence
  Description of Artificial Sequence: Synthetic oligonucleotide
  Target: ATXN1; (+) strand; PAM type: NNGRRT; PAM sequence: CCGAGT
tgcatattttaaaatcaaag

SEQ ID NO: 23028 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tcaagttcatccgctgtaaa

SEQ ID NO: 23029 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ataagaagtaaggacaactc

SEQ ID NO: 23030 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aggatgctggcttcctggtg

SEQ ID NO: 23031 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tgataaggcggccagcaagc

SEQ ID NO: 23032 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ggcggccagcaagctggagt

SEQ ID NO: 23033 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ggtgtccagctgaaaagagg

SEQ ID NO: 23034 - DNA, 20 bp, Artificial Sequence
  Description of Artificial Sequence: Synthetic oligonucleotide
  Target: ATXN1; (+) strand; PAM type: NNGRRT; PAM sequence: AGGGAT
gcatcagtacctccacaccc

SEQ ID NO: 23035 - DNA, 20 bp, Artificial Sequence
  Description of Artificial Sequence: Synthetic oligonucleotide
  Target: ATXN1; (+) strand; PAM type: NNGRRT; PAM sequence: GCGGAT
attttgggaggctgaggcga

SEQ ID NO: 23036 - DNA, 20 bp, Artificial Sequence
  Description of Artificial Sequence: Synthetic oligonucleotide
  Target: ATXN1; (+) strand; PAM type: NNGRRT; PAM sequence: CTGGGT
actaaaaatacaaaaattag

SEQ ID NO: 23037 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ctgtaatcccagctactcag

SEQ ID NO: 23038 - DNA, 20 bp, Artificial Sequence
  Description of Artificial Sequence: Synthetic oligonucleotide
  Target: ATXN1; (+) strand; PAM type: NNGRRT; PAM sequence: GGGAGT
caggagaacagcttgaacca

SEQ ID NO: 23039 - DNA, 20 bp, Artificial Sequence
  Description of Artificial Sequence: Synthetic oligonucleotide
  Target: ATXN1; (+) strand; PAM type: NNGRRT; PAM sequence: CAGAGT
actgcactccagcctggtga

SEQ ID NO: 23040 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aaaaaaaaaaaaagcttaac

SEQ ID NO: 23041 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaaaaaaaagcttaacttga

SEQ ID NO: 23042 - DNA, 20 bp, Artificial Sequence
  Description of Artificial Sequence: Synthetic oligonucleotide
  Target: ATXN1; (+) strand; PAM type: NNGRRT; PAM sequence: GAGGGT
acttgaatgaatgggaacaa

SEQ ID NO: 23043 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gcaccagcaaaatgcatttg

SEQ ID NO: 23044 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gttcactgctgtagtgttat

SEQ ID NO: 23045 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttttttatttaataattaag

SEQ ID NO: 23046 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ataattaagatgaataatct

SEQ ID NO: 23047 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tagctatgcaaaaacactga

SEQ ID NO: 23048 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ttaagagcagcgtataataa

SEQ ID NO: 23049 - DNA, 20 bp, Artificial Sequence
  Description of Artificial Sequence: Synthetic oligonucleotide
  Target: ATXN1; (+) strand; PAM type: NNGRRT; PAM sequence: AGGAAT
taataaatgggtagcctaaa

SEQ ID NO: 23050 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cctaaaaggaatgctttgaa

SEQ ID NO: 23051 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tttaaaactccaacaaagga

SEQ ID NO: 23052 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ttctaaggttcaagattcgt

SEQ ID NO: 23053 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttcaacaacaaatgtttgtt

SEQ ID NO: 23054 - DNA, 20 bp, Artificial Sequence
  Description of Artificial Sequence: Synthetic oligonucleotide
  Target: ATXN1; (+) strand; PAM type: NNGRRT; PAM sequence: ATGAAT
caaatgtttgtttggaataa

SEQ ID NO: 23055 - DNA, 20 bp, Artificial Sequence
  Description of Artificial Sequence: Synthetic oligonucleotide
  Target: ATXN1; (+) strand; PAM type: NNGRRT; PAM sequence: ATGAAT
agtttaatcacctataagtt

SEQ ID NO: 23056 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cttcaatcattcccaaatga

SEQ ID NO: 23057 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gattgaatcatttacctcgc

SEQ ID NO: 23058 - DNA, 20 bp, Artificial Sequence
  Description of Artificial Sequence: Synthetic oligonucleotide
  Target: ATXN1; (+) strand; PAM type: NNGRRT; PAM sequence: ACGGGT
aggcttgctcctgaaattat

SEQ ID NO: 23059 - DNA, 20 bp, Artificial Sequence
  Description of Artificial Sequence: Synthetic oligonucleotide
  Target: ATXN1; (+) strand; PAM type: NNGRRT; PAM sequence: ATGGGT
atcacctactaagctatgtg

SEQ ID NO: 23060 - DNA, 20 bp, Artificial Sequence
  Description of Artificial Sequence: Synthetic oligonucleotide
  Target: ATXN1; (+) strand; PAM type: NNGRRT; PAM sequence: CCGGAT
ggtaaaaggtgtttccaaga

SEQ ID NO: 23061 - DNA, 20 bp, Artificial Sequence
  Description of Artificial Sequence: Synthetic oligonucleotide
  Target: ATXN1; (+) strand; PAM type: NNGRRT; PAM sequence: TAGGGT
attcatgtgtaatttcaaaa

SEQ ID NO: 23062 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gtggaacaaattactggggc

SEQ ID NO: 23063 - DNA, 20 bp, Artificial Sequence
  Description of Artificial Sequence: Synthetic oligonucleotide
  Target: ATXN1; (+) strand; PAM type: NNGRRT; PAM sequence: CTGGAT
agtaaggaagaaggttcctg

SEQ ID NO: 23064 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tgctggatacttggtaagag

SEQ ID NO: 23065 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gatacttggtaagaggtggg

SEQ ID NO: 23066 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ggtaagaggtgggtggggtc

SEQ ID NO: 23067 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tccaggatttccaggggact

SEQ ID NO: 23068 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tttctattctgactttctaa

SEQ ID NO: 23069 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aaaaatacaaaaaatattag

SEQ ID NO: 23070 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ttgcaccactgcattccagc

SEQ ID NO: 23071 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctgcattccagcctggatga

SEQ ID NO: 23072 - DNA, 20 bp, Artificial Sequence
  Description of Artificial Sequence: Synthetic oligonucleotide
  Target: ATXN1; (+) strand; PAM type: NNGRRT; PAM sequence: CAGAGT
atcaatttgtttcaacaatc

SEQ ID NO: 23073 - DNA, 20 bp, Artificial Sequence
  Description of Artificial Sequence: Synthetic oligonucleotide
  Target: ATXN1; (+) strand; PAM type: NNGRRT; PAM sequence: TAGAGT
cagaaaattctcacgtattt

SEQ ID NO: 23074 - DNA, 20 bp, Artificial Sequence
  Description of Artificial Sequence: Synthetic oligonucleotide
  Target: ATXN1; (+) strand; PAM type: NNGRRT; PAM sequence: CAGGGT
attctcacgtattttagagt

SEQ ID NO: 23075 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atcataaatcttaaagtttt

SEQ ID NO: 23076 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ggtcccagaggaaagataag

SEQ ID NO: 23077 - DNA, 20 bp, Artificial Sequence
  Description of Artificial Sequence: Synthetic oligonucleotide
  Target: ATXN1; (+) strand; PAM type: NNGRRT; PAM sequence: TAGGAT
aagaaggtcaagttcatctg

SEQ ID NO: 23078 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gtgcctccccattgggcccc

SEQ ID NO: 23079 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaacaccacagtgtttcaat

SEQ ID NO: 23080 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctttttttttttttttaga

SEQ ID NO: 23081 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcgctctgtgacccaggc

SEQ ID NO: 23082 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcactgcaaccttcgcctc

SEQ ID NO: 23083 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtacaga

SEQ ID NO: 23084 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tggggtttcaccgtgttggc

SEQ ID NO: 23085 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ccaaattctgaacggggaaa

SEQ ID NO: 23086 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aaatgctttgacatcacaaa

SEQ ID NO: 23087 - DNA, 20 bp, Artificial Sequence
  Description of Artificial Sequence: Synthetic oligonucleotide
  Target: ATXN1; (+) strand; PAM type: NNGRRT; PAM sequence: AGGAAT
cggctactcatttacaaaac

SEQ ID NO: 23088 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aaaagataaaagcagccgac

SEQ ID NO: 23089 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tctgctaagggcctcctacc

SEQ ID NO: 23090 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cctcaactcacccagagact

SEQ ID NO: 23091 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gacctccaacagcccaacag

SEQ ID NO: 23092 - DNA, 20 bp, Artificial Sequence
  Description of Artificial Sequence: Synthetic oligonucleotide
  Target: ATXN1; (+) strand; PAM type: NNGRRT; PAM sequence: TTGAGT
acagttgagtgtacacagcc

SEQ ID NO: 23093 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aggcaggcccccaccataaa

SEQ ID NO: 23094 - DNA, 20 bp, Artificial Sequence
  Description of Artificial Sequence: Synthetic oligonucleotide
  Target: ATXN1; (+) strand; PAM type: NNGRRT; PAM sequence: CTGAGT
cttaggcctcatttggaggt

SEQ ID NO: 23095 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gcctcatttggaggtctgag

SEQ ID NO: 23096 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tgaaactggcctggtggctg

SEQ ID NO: 23097 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aggggaagaggtgagcaggc

SEQ ID NO: 23098 - DNA, 20 bp, Artificial Sequence
  Description of Artificial Sequence: Synthetic oligonucleotide
  Target: ATXN1; (+) strand; PAM type: NNGRRT; PAM sequence: GGGGAT
agaggtgagcaggctggggt

SEQ ID NO: 23099 - DNA, 20 bp, Artificial Sequence
  Description of Artificial Sequence: Synthetic oligonucleotide
  Target: ATXN1; (+) strand; PAM type: NNGRRT; PAM sequence: GAGGGT
cgtcacacaggtactggcat

SEQ ID NO: 23100 - DNA, 20 bp, Artificial Sequence
  Description of Artificial Sequence: Synthetic oligonucleotide
  Target: ATXN1; (+) strand; PAM type: NNGRRT; PAM sequence: CCGAGT
ctggcatgagggtgtgggga

SEQ ID NO: 23101 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gggtgtggggaccgagtcct

SEQ ID NO: 23102 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ggaccgagtcctatgagttc

SEQ ID NO: 23103 - DNA, 20 bp, Artificial Sequence
  Description of Artificial Sequence: Synthetic oligonucleotide
  Target: ATXN1; (+) strand; PAM type: NNGRRT; PAM sequence: CAGGAT
atgagttcctgggtctctac

SEQ ID NO: 23104 - DNA, 20 bp, Artificial Sequence
  Description of Artificial Sequence: Synthetic oligonucleotide
  Target: ATXN1; (+) strand; PAM type: NNGRRT; PAM sequence: TCGAGT
caggattttccaggtcagca

SEQ ID NO: 23105 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tagaagtggtgggaactgat

SEQ ID NO: 23106 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gatgggaatgaccatggaag

SEQ ID NO: 23107 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ggaagctgaatccacaaacc

SEQ ID NO: 23108 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tctccttatcttgtcctctc

SEQ ID NO: 23109 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tggataaggcttcgtaaagg

SEQ ID NO: 23110 - DNA, 20 bp, Artificial Sequence
  Description of Artificial Sequence: Synthetic oligonucleotide
  Target: ATXN1; (+) strand; PAM type: NNGRRT; PAM sequence: AGGAAT
agggaagaccacttgagccc

SEQ ID NO: 23111 - DNA, 20 bp, Artificial Sequence
  Description of Artificial Sequence: Synthetic oligonucleotide
  Target: ATXN1; (+) strand; PAM type: NNGRRT; PAM sequence: AGGAGT
taggaccattgcttgagccc

SEQ ID NO: 23112 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttgtatcactgctctccagc

SEQ ID NO: 23113 - DNA, 20 bp, Artificial Sequence
  Description of Artificial Sequence: Synthetic oligonucleotide
  Target: ATXN1; (+) strand; PAM type: NNGRRT; PAM sequence: CTGGAT
agttgttcctcttcagacaa

SEQ ID NO: 23114 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gcttgctttgttgcccaggc

SEQ ID NO: 23115 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gatcctcccacttcagcctt

SEQ ID NO: 23116 - DNA, 20 bp, Artificial Sequence
  Description of Artificial Sequence: Synthetic oligonucleotide
  Target: ATXN1; (+) strand; PAM type: NNGRRT; PAM sequence: CTGGAT
cactgcacccagctgaccac

SEQ ID NO: 23117 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gaagtctgactgttagatgt

SEQ ID NO: 23118 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gatgttttcatgttatatat

SEQ ID NO: 23119 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tgcagcacagtatcaattta

SEQ ID NO: 23120 - DNA, 20 bp, Artificial Sequence
  Description of Artificial Sequence: Synthetic oligonucleotide
  Target: ATXN1; (+) strand; PAM type: NNGRRT; PAM sequence: TAGAAT
taattgcagaacttgggagc

SEQ ID NO: 23121 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tgtagacaccgaggcttaaa

SEQ ID NO: 23122 - DNA, 20 bp, Artificial Sequence
  Description of Artificial Sequence: Synthetic oligonucleotide
  Target: ATXN1; (+) strand; PAM type: NNGRRT; PAM sequence: GAGAAT
acaattcaaaattattcaaa

SEQ ID NO: 23123 - DNA, 20 bp, Artificial Sequence
  Description of Artificial Sequence: Synthetic oligonucleotide
  Target: ATXN1; (+) strand; PAM type: NNGRRT; PAM sequence: AGGGAT
atgggggaagaggtatgctc

SEQ ID NO: 23124 - DNA, 20 bp, Artificial Sequence
  Description of Artificial Sequence: Synthetic oligonucleotide
  Target: ATXN1; (+) strand; PAM type: NNGRRT; PAM sequence: TTGGAT
agctcttggttaagcaactt

SEQ ID NO: 23125 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctcagtaagaagattagcag

SEQ ID NO: 23126 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ggttattcaagcagtgaccc

SEQ ID NO: 23127 - DNA, 20 bp, Artificial Sequence
  Description of Artificial Sequence: Synthetic oligonucleotide
  Target: ATXN1; (+) strand; PAM type: NNGRRT; PAM sequence: CCGGGT
gaacaagctatagaaacttg

SEQ ID NO: 23128 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actttgggaggctgagatgg

SEQ ID NO: 23129 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggaggatcacttgagccc

SEQ ID NO: 23130 - DNA, 20 bp, Artificial Sequence
  Description of Artificial Sequence: Synthetic oligonucleotide
  Target: ATXN1; (+) strand; PAM type: NNGRRT; PAM sequence: GAGGAT
catatagtccagatactcag

SEQ ID NO: 23131 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tactcaggaggatgaggtgg

SEQ ID NO: 23132 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tggggggatcgcttgaaccc

SEQ ID NO: 23133 - DNA, 20 bp, Artificial Sequence
  Description of Artificial Sequence: Synthetic oligonucleotide
  Target: ATXN1; (+) strand; PAM type: NNGRRT; PAM sequence: TGGAGT
cacgccactgcactccagcc

SEQ ID NO: 23134 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctcaaaaacaaacaaacaaa

SEQ ID NO: 23135 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aaagaatgacaattaactca

SEQ ID NO: 23136 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acaattaactcaaagagtta

SEQ ID NO: 23137 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ctcacctgcgaacacatgtg

SEQ ID NO: 23138 - DNA, 20 bp, Artificial Sequence
  Description of Artificial Sequence: Synthetic oligonucleotide
  Target: ATXN1; (+) strand; PAM type: NNGRRT; PAM sequence: CTGGAT
cgaacacatgtgatgggtac

SEQ ID NO: 23139 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gaccaggtctaagttatttc

SEQ ID NO: 23140 - DNA, 20 bp, Artificial Sequence
  Description of Artificial Sequence: Synthetic oligonucleotide
  Target: ATXN1; (+) strand; PAM type: NNGRRT; PAM sequence: GAGGAT
atcttaagatccaaagtgca

SEQ ID NO: 23141 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tccaaagtgcagaggatctt

SEQ ID NO: 23142 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aatagctctggagccatgca

SEQ ID NO: 23143 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tgtttgtggtttttttgttt

SEQ ID NO: 23144 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tcttgctctgtcgcccaggc

SEQ ID NO: 23145 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcactgtgacctccgactc

SEQ ID NO: 23146 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtagaga

SEQ ID NO: 23147 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccgaagtgc

SEQ ID NO: 23148 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ccatcacgcccggccctaaa

SEQ ID NO: 23149 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gggggaaagtatacagttcc

SEQ ID NO: 23150 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tttgctcttattgcgcaggc

SEQ ID NO: 23151 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ctcactgcaacctctgcctc

SEQ ID NO: 23152 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaagtagc

SEQ ID NO: 23153 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtagaga

SEQ ID NO: 23154 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gccttggcctcccaaagtgt

SEQ ID NO: 23155 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tttctacatctgtgaagtga

SEQ ID NO: 23156 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ggaaacctggacatataagg

SEQ ID NO: 23157 - DNA, 20 bp, Artificial Sequence
  Description of Artificial Sequence: Synthetic oligonucleotide
  Target: ATXN1; (+) strand; PAM type: NNGRRT; PAM sequence: TGGAAT
attcatgtgtaacttcaaaa

SEQ ID NO: 23158 - DNA, 20 bp, Artificial Sequence
  Description of Artificial Sequence: Synthetic oligonucleotide
  Target: ATXN1; (+) strand; PAM type: NNGRRT; PAM sequence: TGGGGT
caaaatggaatgtcagtgtc

SEQ ID NO: 23159 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atggaatgtcagtgtctggg

SEQ ID NO: 23160 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gaaatccaaagggaagttct

SEQ ID NO: 23161 - DNA, 20 bp, Artificial Sequence
  Description of Artificial Sequence: Synthetic oligonucleotide
  Target: ATXN1; (+) strand; PAM type: NNGRRT; PAM sequence: ATGAAT
catctgataggtcaaaatac

SEQ ID NO: 23162 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tagtagaaaacaaaaatacc

SEQ ID NO: 23163 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ctcaatcggtggtgagacaa

SEQ ID NO: 23164 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ccagctgaaattgctatgtg

SEQ ID NO: 23165 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tgctatgtgctgaatgacat

SEQ ID NO: 23166 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gttctagaaccatctgcgac

SEQ ID NO: 23167 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ttgcagctggaccagtgaga

SEQ ID NO: 23168 - DNA, 20 bp, Artificial Sequence
  Description of Artificial Sequence: Synthetic oligonucleotide
  Target: ATXN1; (+) strand; PAM type: NNGRRT; PAM sequence: CTGGGT
agtcaataaataaagctctt

SEQ ID NO: 23169 - DNA, 20 bp, Artificial Sequence
  Description of Artificial Sequence: Synthetic oligonucleotide
  Target: ATXN1; (+) strand; PAM type: NNGRRT; PAM sequence: TTGGAT
taattttgactacactgtgt

SEQ ID NO: 23170 - DNA, 20 bp, Artificial Sequence
  Description of Artificial Sequence: Synthetic oligonucleotide
  Target: ATXN1; (+) strand; PAM type: NNGRRT; PAM sequence: AAGGAT
cctagtaggagagcgcctgc

SEQ ID NO: 23171 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tggggagaagcaataatctg

SEQ ID NO: 23172 - DNA, 20 bp, Artificial Sequence
  Description of Artificial Sequence: Synthetic oligonucleotide
  Target: ATXN1; (+) strand; PAM type: NNGRRT; PAM sequence: AAGGGT
atgccactgggaaaagtgca

SEQ ID NO: 23173 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cactgggaaaagtgcaaagg

SEQ ID NO: 23174 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agggtgaattgggcaccact

SEQ ID NO: 23175 - DNA, 20 bp, Artificial Sequence
  Description of Artificial Sequence: Synthetic oligonucleotide
  Target: ATXN1; (+) strand; PAM type: NNGRRT; PAM sequence: GAGAGT
aaagtgactggctgctactt

SEQ ID NO: 23176 - DNA, 20 bp, Artificial Sequence
  Description of Artificial Sequence: Synthetic oligonucleotide
  Target: ATXN1; (+) strand; PAM type: NNGRRT; PAM sequence: AGGGAT
atactcctggggaccattac

SEQ ID NO: 23177 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tggtgtgctaagtgtcctga

SEQ ID NO: 23178 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agaaagcatcacataaaagg

SEQ ID NO: 23179 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gctgaatcagaaatgtgtgt

SEQ ID NO: 23180 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ccatgcccatggccatctgg

SEQ ID NO: 23181 - DNA, 20 bp, Artificial Sequence
  Description of Artificial Sequence: Synthetic oligonucleotide
  Target: ATXN1; (+) strand; PAM type: NNGRRT; PAM sequence: TGGAGT
cctctgctacaaagggggct

SEQ ID NO: 23182 - DNA, 20 bp, Artificial Sequence
  Description of Artificial Sequence: Synthetic oligonucleotide
  Target: ATXN1; (+) strand; PAM type: NNGRRT; PAM sequence: TAGGGT
aagggggcttggagtgaagc

SEQ ID NO: 23183 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gctagggtcagggagaagtt

SEQ ID NO: 23184 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ttcagcttaagaccgaggaa

SEQ ID NO: 23185 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gaggagacccagacttaggc

SEQ ID NO: 23186 - DNA, 20 bp, Artificial Sequence
  Description of Artificial Sequence: Synthetic oligonucleotide
  Target: ATXN1; (+) strand; PAM type: NNGRRT; PAM sequence: TAGGAT
accaacttacaaaaaaaaat

SEQ ID NO: 23187 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aacaaatcagatagatgcta

SEQ ID NO: 23188 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttttctaaactgaagaaata

SEQ ID NO: 23189 - DNA, 20 bp, Artificial Sequence
  Description of Artificial Sequence: Synthetic oligonucleotide
  Target: ATXN1; (+) strand; PAM type: NNGRRT; PAM sequence: AAGGGT
actacacagctctaatggca

SEQ ID NO: 23190 - DNA, 20 bp, Artificial Sequence
  Description of Artificial Sequence: Synthetic oligonucleotide
  Target: ATXN1; (+) strand; PAM type: NNGRRT; PAM sequence: GAGAGT
caactttcctactaaggtat

SEQ ID NO: 23191 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aaaaaataaaaaaggcattc

SEQ ID NO: 23192 - DNA, 20 bp, Artificial Sequence
  Description of Artificial Sequence: Synthetic oligonucleotide
  Target: ATXN1; (+) strand; PAM type: NNGRRT; PAM sequence: TAGAAT
caaaaacacaatgtatttca

SEQ ID NO: 23193 - DNA, 20 bp, Artificial Sequence
  Description of Artificial Sequence: Synthetic oligonucleotide
  Target: ATXN1; (+) strand; PAM type: NNGRRT; PAM sequence: AGGGGT
aattttaaacaataaagaaa

SEQ ID NO: 23194 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gctttaaaacagttcacaat

SEQ ID NO: 23195 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actttgggaggccgaggtgg

SEQ ID NO: 23196 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgggaggattgcttgaggcc

SEQ ID NO: 23197 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ctacttaggaggctgaggtg

SEQ ID NO: 23198 - DNA, 20 bp, Artificial Sequence
  Description of Artificial Sequence: Synthetic oligonucleotide
  Target: ATXN1; (+) strand; PAM type: NNGRRT; PAM sequence: GCGAGT
gccaggaggtcaaggctgca

SEQ ID NO: 23199 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ggagagcatataacaaacaa

SEQ ID NO: 23200 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tatttaaaagtaatcataaa

SEQ ID NO: 23201 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctaactttaaaaaagaaaag

SEQ ID NO: 23202 - DNA, 20 bp, Artificial Sequence
  Description of Artificial Sequence: Synthetic oligonucleotide
  Target: ATXN1; (+) strand; PAM type: NNGRRT; PAM sequence: GAGAAT
agaaaaggagaattccaaag

SEQ ID NO: 23203 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tagaagattaaatataaggt

SEQ ID NO: 23204 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ggaaaatgagggaaatatca

SEQ ID NO: 23205 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tcaaggaatcataaaaccaa

SEQ ID NO: 23206 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aataaaaagatgacaaaaat

SEQ ID NO: 23207 - DNA, 20 bp, Artificial Sequence
  Description of Artificial Sequence: Synthetic oligonucleotide
  Target: ATXN1; (+) strand; PAM type: NNGRRT; PAM sequence: AAGAAT
taattcgttttgaaaagcaa

SEQ ID NO: 23208 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctcagatggtgtcataaatt

SEQ ID NO: 23209 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ttacaagaagattggggcaa

SEQ ID NO: 23210 - DNA, 20 bp, Artificial Sequence
  Description of Artificial Sequence: Synthetic oligonucleotide
  Target: ATXN1; (+) strand; PAM type: NNGRRT; PAM sequence: AGGGGT
acatatctaaagcattcaac

SEQ ID NO: 23211 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctgacaagagatacattcca

SEQ ID NO: 23212 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttttttttttttttttgaga

SEQ ID NO: 23213 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgttgcccattc

SEQ ID NO: 23214 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ctcactgcaagctccgcctc

SEQ ID NO: 23215 - DNA, 20 bp, Artificial Sequence
  Description of Artificial Sequence: Synthetic oligonucleotide
  Target: ATXN1; (+) strand; PAM type: NNGRRT; PAM sequence: TCGAGT
cattctcctgcctcagcctt

SEQ ID NO: 23216 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttttgtatttttagtagaga

SEQ ID NO: 23217 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaaagtgc

SEQ ID NO: 23218 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ttaataaagatatagagaag

SEQ ID NO: 23219 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ctcatggaacattaacaaaa

SEQ ID NO: 23220 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aattaacttgtacattcaaa

SEQ ID NO: 23221 - DNA, 20 bp, Artificial Sequence
  Description of Artificial Sequence: Synthetic oligonucleotide
  Target: ATXN1; (+) strand; PAM type: NNGRRT; PAM sequence: TAGAGT
agaattcttctaaataggtg

SEQ ID NO: 23222 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gtataaaagataataaatta

SEQ ID NO: 23223 - DNA, 20 bp, Artificial Sequence
  Description of Artificial Sequence: Synthetic oligonucleotide
  Target: ATXN1; (+) strand; PAM type: NNGRRT; PAM sequence: GGGGGT
caactcaataaattagaaaa

SEQ ID NO: 23224 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggaggctgaggcag

SEQ ID NO: 23225 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ggtggaggttgcagtgagcc

SEQ ID NO: 23226 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cagcactttgggaggccgag

SEQ ID NO: 23227 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccgaggcgg

SEQ ID NO: 23228 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cactcgggaggctgaggcag

SEQ ID NO: 23229 - DNA, 20 bp, Artificial Sequence
  Description of Artificial Sequence: Synthetic oligonucleotide
  Target: ATXN1; (+) strand; PAM type: NNGRRT; PAM sequence: TGGAAT
accaaattaaaaataagaag

SEQ ID NO: 23230 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ggaataaattcacaaatatt

SEQ ID NO: 23231 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttgactgtgttaacaaaatt

SEQ ID NO: 23232 - DNA, 20 bp, Artificial Sequence
  Description of Artificial Sequence: Synthetic oligonucleotide
  Target: ATXN1; (+) strand; PAM type: NNGRRT; PAM sequence: CAGGAT
catgctttgggaggctgagg

SEQ ID NO: 23233 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gaggcaggattgctcaaggc

SEQ ID NO: 23234 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tacttgggaggctgaggcgg

SEQ ID NO: 23235 - DNA, 20 bp, Artificial Sequence
  Description of Artificial Sequence: Synthetic oligonucleotide
  Target: ATXN1; (+) strand; PAM type: NNGRRT; PAM sequence: AGGGGT
cgggaggattgcttgagccc

SEQ ID NO: 23236 - DNA, 20 bp, Artificial Sequence
  Description of Artificial Sequence: Synthetic oligonucleotide
  Target: ATXN1; (+) strand; PAM type: NNGRRT; PAM sequence: AGGGGT
attattatagacaaactttt

SEQ ID NO: 23237 - DNA, 20 bp, Artificial Sequence
  Description of Artificial Sequence: Synthetic oligonucleotide
  Target: ATXN1; (+) strand; PAM type: NNGRRT; PAM sequence: CAGGAT
acaggtaatttcaaagcttc

SEQ ID NO: 23238 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgtcagcttgcccatttgta

SEQ ID NO: 23239 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ttttgtcatcatcgcatctt

SEQ ID NO: 23240 - DNA, 20 bp, Artificial Sequence
  Description of Artificial Sequence: Synthetic oligonucleotide
  Target: ATXN1; (+) strand; PAM type: NNGRRT; PAM sequence: GGGAAT
atcttgagagtagagaggaa

SEQ ID NO: 23241 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atggtacatgactctttctt

SEQ ID NO: 23242 - DNA, 20 bp, Artificial Sequence
  Description of Artificial Sequence: Synthetic oligonucleotide
  Target: ATXN1; (+) strand; PAM type: NNGRRT; PAM sequence: ATGGGT
cttaagaatggttctctttt

SEQ ID NO: 23243 - DNA, 20 bp, Artificial Sequence
  Description of Artificial Sequence: Synthetic oligonucleotide
  Target: ATXN1; (+) strand; PAM type: NNGRRT; PAM sequence: GAGGGT
cttaaatattctgtgggaaa

SEQ ID NO: 23244 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tgggaaagagggttgaaaat

SEQ ID NO: 23245 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aagagggttgaaaattagaa

SEQ ID NO: 23246 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ttatattaaaagttaaaaac

SEQ ID NO: 23247 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cagcactttgggaggctgaa

SEQ ID NO: 23248 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggctgaagcgg

SEQ ID NO: 23249 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggtggatcacttgaggtc

SEQ ID NO: 23250 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gcctgtaatcccagatactt

SEQ ID NO: 23251 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggagtctgaggccg

SEQ ID NO: 23252 - DNA, 20 bp, Artificial Sequence
  Description of Artificial Sequence: Synthetic oligonucleotide
  Target: ATXN1; (+) strand; PAM type: NNGRRT; PAM sequence: AGGGGT
attattatagacaaactttt

SEQ ID NO: 23253 - DNA, 20 bp, Artificial Sequence
  Description of Artificial Sequence: Synthetic oligonucleotide
  Target: ATXN1; (+) strand; PAM type: NNGRRT; PAM sequence: CAGGAT
acaggtaatttcaaagcttc

SEQ ID NO: 23254 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgtcagcttgcccatttgta

SEQ ID NO: 23255 - DNA, 20 bp, Artificial Sequence
  Description of Artificial Sequence: Synthetic oligonucleotide
  Target: ATXN1; (+) strand; PAM type: NNGRRT; PAM sequence: AGGAAT
atcttgaaagtagagaggaa

SEQ ID NO: 23256 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atggtacatgactctttctt

SEQ ID NO: 23257 - DNA, 20 bp, Artificial Sequence
  Description of Artificial Sequence: Synthetic oligonucleotide
  Target: ATXN1; (+) strand; PAM type: NNGRRT; PAM sequence: ACGGGT
cttaagaatggttctctttt

SEQ ID NO: 23258 - DNA, 20 bp, Artificial Sequence
  Description of Artificial Sequence: Synthetic oligonucleotide
  Target: ATXN1; (+) strand; PAM type: NNGRRT; PAM sequence: GAGGGT
cttaaatattctgtgggaaa

SEQ ID NO: 23259 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tgggaaagagggttgaaaat

SEQ ID NO: 23260 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aagagggttgaaaattagaa

SEQ ID NO: 23261 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ttatattaaaagttaaaaac

SEQ ID NO: 23262 - DNA, 20 bp, Artificial Sequence
  Description of Artificial Sequence: Synthetic oligonucleotide
  Target: ATXN1; (+) strand; PAM type: NNGRRT; PAM sequence: GCGGGT
ccagcactttgggaggctga

SEQ ID NO: 23263 - DNA, 20 bp, Artificial Sequence
  Description of Artificial Sequence: Synthetic oligonucleotide
  Target: ATXN1; (+) strand; PAM type: NNGRRT; PAM sequence: GTGGAT
cactttgggaggctgagcgg

SEQ ID NO: 23264 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggtggatcacttgaggtc

SEQ ID NO: 23265 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gcctgtaatcccagatattt

SEQ ID NO: 23266 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tatttgggagtctgtggccg

SEQ ID NO: 23267 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gtgcgccactgcactccagc

SEQ ID NO: 23268 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gaaaaaaaaaaattaaattc

SEQ ID NO: 23269 - DNA, 20 bp, Artificial Sequence
  Description of Artificial Sequence: Synthetic oligonucleotide
  Target: ATXN1; (+) strand; PAM type: NNGRRT; PAM sequence: CAGGAT
attattatttggcataccat

SEQ ID NO: 23270 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tggaaatgttattgtctact

SEQ ID NO: 23271 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tgtctacttagaatatctaa

SEQ ID NO: 23272 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cagcattttgggaggccaag

SEQ ID NO: 23273 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tgggtggctcacctgaggtc

SEQ ID NO: 23274 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tacttgggaggctgagacag

SEQ ID NO: 23275 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcatgccactgcactccagc

SEQ ID NO: 23276 - DNA, 20 bp, Artificial Sequence
  Description of Artificial Sequence: Synthetic oligonucleotide
  Target: ATXN1; (+) strand; PAM type: NNGRRT; PAM sequence: GCGAGT
aatttgctgtctgaaaatag

SEQ ID NO: 23277 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gttaatctctaatttataca

SEQ ID NO: 23278 - DNA, 20 bp, Artificial Sequence
  Description of Artificial Sequence: Synthetic oligonucleotide
  Target: ATXN1; (+) strand; PAM type: NNGRRT; PAM sequence: TAGGGT
aggaaaaaacacaatctata

SEQ ID NO: 23279 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tggtactaactggcagtttc

SEQ ID NO: 23280 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ggcagtttcaggaatccacc

SEQ ID NO: 23281 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ctaaaggaaaaacattgtgc

SEQ ID NO: 23282 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gtgcatggatcaaaaattac

SEQ ID NO: 23283 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agtaaagacttccattctct

SEQ ID NO: 23284 - DNA, 20 bp, Artificial Sequence
  Description of Artificial Sequence: Synthetic oligonucleotide
  Target: ATXN1; (+) strand; PAM type: NNGRRT; PAM sequence: AAGAAT
attagtctatgtacacatga

SEQ ID NO: 23285 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tgctgaaaaaaaatatatga

SEQ ID NO: 23286 - DNA, 20 bp, Artificial Sequence
  Description of Artificial Sequence: Synthetic oligonucleotide
  Target: ATXN1; (+) strand; PAM type: NNGRRT; PAM sequence: TAGAAT
attaaaatcttctaaactca

SEQ ID NO: 23287 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aaaaacaaatatcaagataa

SEQ ID NO: 23288 - DNA, 20 bp, Artificial Sequence
  Description of Artificial Sequence: Synthetic oligonucleotide
  Target: ATXN1; (+) strand; PAM type: NNGRRT; PAM sequence: GCGGAT
agaatataaggcttagaaat

SEQ ID NO: 23289 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgggaggctgaggcag

SEQ ID NO: 23290 - DNA, 20 bp, Artificial Sequence
  Description of Artificial Sequence: Synthetic oligonucleotide
  Target: ATXN1; (+) strand; PAM type: NNGRRT; PAM sequence: TTGAAT
taatatttgacaaaagttca

SEQ ID NO: 23291 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ataaagaactacaataaatt

SEQ ID NO: 23292 - DNA, 20 bp, Artificial Sequence
  Description of Artificial Sequence: Synthetic oligonucleotide
  Target: ATXN1; (+) strand; PAM type: NNGRRT; PAM sequence: GTGAAT
taaatagttatctgacccta

SEQ ID NO: 23293 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaaaattgcagccataaaa

SEQ ID NO: 23294 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atcatgtcctttacagggac

SEQ ID NO: 23295 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gcatgttctcactcataagt

SEQ ID NO: 23296 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gagggagggacaaggggagg

SEQ ID NO: 23297 - DNA, 20 bp, Artificial Sequence
  Description of Artificial Sequence: Synthetic oligonucleotide
  Target: ATXN1; (+) strand; PAM type: NNGRRT; PAM sequence: CCGAAT
gaagagtgttaagacaaata

SEQ ID NO: 23298 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aagtaaaacaaacaaaacaa

SEQ ID NO: 23299 - DNA, 20 bp, Artificial Sequence
  Description of Artificial Sequence: Synthetic oligonucleotide
  Target: ATXN1; (+) strand; PAM type: NNGRRT; PAM sequence: CAGGGT
acaaaacaaaagaattcagg

SEQ ID NO: 23300 - DNA, 20 bp, Artificial Sequence
  Description of Artificial Sequence: Synthetic oligonucleotide
  Target: ATXN1; (+) strand; PAM type: NNGRRT; PAM sequence: ATGGAT
actttgggaggccgaggcag

SEQ ID NO: 23301 - DNA, 20 bp, Artificial Sequence
  Description of Artificial Sequence: Synthetic oligonucleotide
  Target: ATXN1; (+) strand; PAM type: NNGRRT; PAM sequence: ACGAGT
cagatggatcacctgaggtc

SEQ ID NO: 23302 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tagtctggaggctgaagcag

SEQ ID NO: 23303 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcgtgccactgcactgcagc

SEQ ID NO: 23304 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gtctcaaaaaaaaaaaaaaa

SEQ ID NO: 23305 - DNA, 20 bp, Artificial Sequence
  Description of Artificial Sequence: Synthetic oligonucleotide
  Target: ATXN1; (+) strand; PAM type: NNGRRT; PAM sequence: AAGAGT
atttccaataccattaaaca

SEQ ID NO: 23306 - DNA, 20 bp, Artificial Sequence
  Description of Artificial Sequence: Synthetic oligonucleotide
  Target: ATXN1; (+) strand; PAM type: NNGRRT; PAM sequence: GTGAGT
caaaataaatacatgtaatt

SEQ ID NO: 23307 - DNA, 20 bp, Artificial Sequence
  Description of Artificial Sequence: Synthetic oligonucleotide
  Target: ATXN1; (+) strand; PAM type: NNGRRT; PAM sequence: ACGAAT
gacaaaaataagcaatgaac

SEQ ID NO: 23308 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tttttaacttatcaaattgg

SEQ ID NO: 23309 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttacagtacttagtgttgtc

SEQ ID NO: 23310 - DNA, 20 bp, Artificial Sequence
  Description of Artificial Sequence: Synthetic oligonucleotide
  Target: ATXN1; (+) strand; PAM type: NNGRRT; PAM sequence: AAGAGT
atggttggcaagtgctcaag

SEQ ID NO: 23311 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aaatgctagataaatagatt

SEQ ID NO: 23312 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ggatggaaattacagtatct

SEQ ID NO: 23313 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgtatttccagtttttctaa

SEQ ID NO: 23314 - DNA, 20 bp, Artificial Sequence
  Description of Artificial Sequence: Synthetic oligonucleotide
  Target: ATXN1; (+) strand; PAM type: NNGRRT; PAM sequence: TGGAGT
acaatttctggggcatgccc

SEQ ID NO: 23315 - DNA, 20 bp, Artificial Sequence
  Description of Artificial Sequence: Synthetic oligonucleotide
  Target: ATXN1; (+) strand; PAM type: NNGRRT; PAM sequence: TTGGAT
atgccctggagtcagactgc

SEQ ID NO: 23316 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tacacaggaggctgaggggc

SEQ ID NO: 23317 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggcaaggatcgcttgagccc

SEQ ID NO: 23318 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ctgttgggctgctgtggcaa

SEQ ID NO: 23319 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cacacacacacacacacaca

SEQ ID NO: 23320 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cacacacacacacagaatat

SEQ ID NO: 23321 - DNA, 20 bp, Artificial Sequence
  Description of Artificial Sequence: Synthetic oligonucleotide
  Target: ATXN1; (+) strand; PAM type: NNGRRT; PAM sequence: TAGGAT
agatgaagattctcatatcc

SEQ ID NO: 23322 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tgcatctttaaggagatcat

SEQ ID NO: 23323 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tggcacaggtgtatttacag

SEQ ID NO: 23324 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tgggtgtgcaaagtgccaag

SEQ ID NO: 23325 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aagtgccaaggaggatgcca

SEQ ID NO: 23326 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ttcagaaggagccccagaaa

SEQ ID NO: 23327 - DNA, 20 bp, Artificial Sequence
  Description of Artificial Sequence: Synthetic oligonucleotide
  Target: ATXN1; (+) strand; PAM type: NNGRRT; PAM sequence: AAGGGT
agatctgaggtcctactaaa

SEQ ID NO: 23328 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ttaggagataacgcagctca

SEQ ID NO: 23329 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aaattggctgaacctgaaat

SEQ ID NO: 23330 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ttatcaaaaaggtgcataca

SEQ ID NO: 23331 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccaaggcag

SEQ ID NO: 23332 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggtggatcacctgaggtc

SEQ ID NO: 23333 - DNA, 20 bp, Artificial Sequence
  Description of Artificial Sequence: Synthetic oligonucleotide
  Target: ATXN1; (+) strand; PAM type: NNGRRT; PAM sequence: GAGAAT
agaccaccctggccaacatg

SEQ ID NO: 23334 - DNA, 20 bp, Artificial Sequence
  Description of Artificial Sequence: Synthetic oligonucleotide
  Target: ATXN1; (+) strand; PAM type: NNGRRT; PAM sequence: CTGGGT
actaaaaatacaaaaattag

SEQ ID NO: 23335 - DNA, 20 bp, Artificial Sequence
  Description of Artificial Sequence: Synthetic oligonucleotide
  Target: ATXN1; (+) strand; PAM type: NNGRRT; PAM sequence: AAGAAT
catctcaaaaacaaaaaaca

SEQ ID NO: 23336 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aacaaagaattaaacaaatg

SEQ ID NO: 23337 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gcagatgataggcagaaaag

SEQ ID NO: 23338 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tggtgtcaggcacactggct

SEQ ID NO: 23339 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tagcctccaccacccacaag

SEQ ID NO: 23340 - DNA, 20 bp, Artificial Sequence
  Description of Artificial Sequence: Synthetic oligonucleotide
  Target: ATXN1; (+) strand; PAM type: NNGRRT; PAM sequence: GCGAGT
cacaagctgggtaaatgtgg

SEQ ID NO: 23341 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gggcgagtagtttaatctat

SEQ ID NO: 23342 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ccaccatttttaaaaatctg

SEQ ID NO: 23343 - DNA, 20 bp, Artificial Sequence
  Description of Artificial Sequence: Synthetic oligonucleotide
  Target: ATXN1; (+) strand; PAM type: NNGRRT; PAM sequence: AAGAGT
taacagcaataactacctca

SEQ ID NO: 23344 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ggaaaaattaaaccggtgaa

SEQ ID NO: 23345 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tgaaggggataaaaactgat

SEQ ID NO: 23346 - DNA, 20 bp, Artificial Sequence
  Description of Artificial Sequence: Synthetic oligonucleotide
  Target: ATXN1; (+) strand; PAM type: NNGRRT; PAM sequence: TAGAGT
aactgatgagggtgttattt

SEQ ID NO: 23347 - DNA, 20 bp, Artificial Sequence
  Description of Artificial Sequence: Synthetic oligonucleotide
  Target: ATXN1; (+) strand; PAM type: NNGRRT; PAM sequence: AAGAGT
taacgataaccaaacaagca

SEQ ID NO: 23348 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ccaaacaagcaaagagtaca

SEQ ID NO: 23349 - DNA, 20 bp, Artificial Sequence
  Description of Artificial Sequence: Synthetic oligonucleotide
  Target: ATXN1; (+) strand; PAM type: NNGRRT; PAM sequence: GCGAAT
gcaaagagtacaagggatgt

SEQ ID NO: 23350 - DNA, 20 bp, Artificial Sequence
  Description of Artificial Sequence: Synthetic oligonucleotide
  Target: ATXN1; (+) strand; PAM type: NNGRRT; PAM sequence: TAGAAT
cgaacacaggaagtactaat

SEQ ID NO: 23351 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctctccaaaaattctatttc

SEQ ID NO: 23352 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gaatgtaaatttttaaaagt

SEQ ID NO: 23353 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tattttaaagacttactatg

SEQ ID NO: 23354 - DNA, 20 bp, Artificial Sequence
  Description of Artificial Sequence: Synthetic oligonucleotide
  Target: ATXN1; (+) strand; PAM type: NNGRRT; PAM sequence: ACGAGT
tactctcagaacagagaaaa

SEQ ID NO: 23355 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ccttttttttttaactgtct

SEQ ID NO: 23356 - DNA, 20 bp, Artificial Sequence
  Description of Artificial Sequence: Synthetic oligonucleotide
  Target: ATXN1; (+) strand; PAM type: NNGRRT; PAM sequence: TTGAAT
caaaaataatcattcatatt

SEQ ID NO: 23357 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ttaataaacattcaagtagt

SEQ ID NO: 23358 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aacacctagaaggaaaattg

SEQ ID NO: 23359 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gaaggaaaattgctgagtca

SEQ ID NO: 23360 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tacacatttgtttttgttaa

SEQ ID NO: 23361 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ctttctaaatggttgtacca

SEQ ID NO: 23362 - DNA, 20 bp, Artificial Sequence
  Description of Artificial Sequence: Synthetic oligonucleotide
  Target: ATXN1; (+) strand; PAM type: NNGRRT; PAM sequence: AAGAAT
caattaatctgaaccaaact

SEQ ID NO: 23363 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tgtctgagaactaaggaaaa

SEQ ID NO: 23364 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tcttcaaaaacatatccgat

SEQ ID NO: 23365 - DNA, 20 bp, Artificial Sequence
  Description of Artificial Sequence: Synthetic oligonucleotide
  Target: ATXN1; (+) strand; PAM type: NNGRRT; PAM sequence: GTGAAT
accattcaattctgcagttt

SEQ ID NO: 23366 - DNA, 20 bp, Artificial Sequence
  Description of Artificial Sequence: Synthetic oligonucleotide
  Target: ATXN1; (+) strand; PAM type: NNGRRT; PAM sequence: TAGAGT
ttcaccctctatgaggtatc

SEQ ID NO: 23367 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cttgggggagaagggaaaag

SEQ ID NO: 23368 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aaaagaagagttgctattta

SEQ ID NO: 23369 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aagagttgctatttaatggg

SEQ ID NO: 23370 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tttcaattttgcaaaataaa

SEQ ID NO: 23371 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tttgcaaaataaaaagagtt

SEQ ID NO: 23372 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggcagatcacctgaggtc

SEQ ID NO: 23373 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tacttgggaggctggggcag

SEQ ID NO: 23374 - DNA, 20 bp, Artificial Sequence
  Description of Artificial Sequence: Synthetic oligonucleotide
  Target: ATXN1; (+) strand; PAM type: NNGRRT; PAM sequence: GGGGAT
caccatcacactccagcctg

SEQ ID NO: 23375 - DNA, 20 bp, Artificial Sequence
  Description of Artificial Sequence: Synthetic oligonucleotide
  Target: ATXN1; (+) strand; PAM type: NNGRRT; PAM sequence: AAGAGT
caagaaaaaaaaaaaaaaaa

SEQ ID NO: 23376 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aaaaaaaaagagttctggag

SEQ ID NO: 23377 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ggtgacagttgtacaacaat

SEQ ID NO: 23378 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgtgaattcagttaatacca

SEQ ID NO: 23379 - DNA, 20 bp, Artificial Sequence
  Description of Artificial Sequence: Synthetic oligonucleotide
  Target: ATXN1; (+) strand; PAM type: NNGRRT; PAM sequence: TCGGGT
tgttttgtttcagtattagg

SEQ ID NO: 23380 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ggtcgggttcaagcaaacag

SEQ ID NO: 23381 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atgctataacagcacatact

SEQ ID NO: 23382 - DNA, 20 bp, Artificial Sequence
  Description of Artificial Sequence: Synthetic oligonucleotide
  Target: ATXN1; (+) strand; PAM type: NNGRRT; PAM sequence: GAGAAT
taacagcacatactgtgggt

SEQ ID NO: 23383 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aaacaagggcttaaatttaa

SEQ ID NO: 23384 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ctaccatatgcccgagggga

SEQ ID NO: 23385 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttgcagtttaacttcaactc

SEQ ID NO: 23386 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tttgtttctgccactgatcg

SEQ ID NO: 23387 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaaaactgtcaacgattact

SEQ ID NO: 23388 - DNA, 20 bp, Artificial Sequence
  Description of Artificial Sequence: Synthetic oligonucleotide
  Target: ATXN1; (+) strand; PAM type: NNGRRT; PAM sequence: GAGAGT
attacagcagaagtgaagaa

SEQ ID NO: 23389 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tttatggccataggcccact

SEQ ID NO: 23390 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tatatgatttttccatcatt

SEQ ID NO: 23391 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aggccatcctggagggggct

SEQ ID NO: 23392 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ctggagggggctagggattt

SEQ ID NO: 23393 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ttcctattatttacaaggcg

SEQ ID NO: 23394 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ggtcccagcagagaaacaga

SEQ ID NO: 23395 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gtatagtaaccatgttatca

SEQ ID NO: 23396 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ccatgttatcaaggagtcat

SEQ ID NO: 23397 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tttcccctcttcgaaaaatg

SEQ ID NO: 23398 - DNA, 20 bp, Artificial Sequence
  Description of Artificial Sequence: Synthetic oligonucleotide
  Target: ATXN1; (+) strand; PAM type: NNGRRT; PAM sequence: CTGAGT
acacataactaatccagtca

SEQ ID NO: 23399 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tggcaatgaaaaaacatatt

SEQ ID NO: 23400 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgaaaaaacatatttggaat

SEQ ID NO: 23401 - DNA, 20 bp, Artificial Sequence
  Description of Artificial Sequence: Synthetic oligonucleotide
  Target: ATXN1; (+) strand; PAM type: NNGRRT; PAM sequence: TTGAGT
acataaatgttctgatcccc

SEQ ID NO: 23402 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aacttgccaccatggaagat

SEQ ID NO: 23403 - DNA, 20 bp, Artificial Sequence
  Description of Artificial Sequence: Synthetic oligonucleotide
  Target: ATXN1; (+) strand; PAM type: NNGRRT; PAM sequence: ACGAGT
catggaagatgtgaattaaa

SEQ ID NO: 23404 - DNA, 20 bp, Artificial Sequence
  Description of Artificial Sequence: Synthetic oligonucleotide
  Target: ATXN1; (+) strand; PAM type: NNGRRT; PAM sequence: CTGGGT
acctgaaaaaaaggaaggaa

SEQ ID NO: 23405 - DNA, 20 bp, Artificial Sequence
  Description of Artificial Sequence: Synthetic oligonucleotide
  Target: ATXN1; (+) strand; PAM type: NNGRRT; PAM sequence: TAGAAT
attaaaaacatttatggcac

SEQ ID NO: 23406 - DNA, 20 bp, Artificial Sequence
  Description of Artificial Sequence: Synthetic oligonucleotide
  Target: ATXN1; (+) strand; PAM type: NNGRRT; PAM sequence: TTGAGT
atttactttatttcttgttt

SEQ ID NO: 23407 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tttatttcttgtttttgagt

SEQ ID NO: 23408 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tcttcctctgttgcccaggc

SEQ ID NO: 23409 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaagcagc

SEQ ID NO: 23410 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttttgtttttttagtagaga

SEQ ID NO: 23411 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taatcatacttaatcaacta

SEQ ID NO: 23412 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ctaatgaatcaagttaactt

SEQ ID NO: 23413 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cttatggatactgttactgg

SEQ ID NO: 23414 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agccctaacttccagtttct

SEQ ID NO: 23415 - DNA, 20 bp, Artificial Sequence
  Description of Artificial Sequence: Synthetic oligonucleotide
  Target: ATXN1; (+) strand; PAM type: NNGRRT; PAM sequence: TAGAAT
catttcaaacttactgtctc

SEQ ID NO: 23416 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tgctgtttaagccactcagt

SEQ ID NO: 23417 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ggcagcaacggtactggaac

SEQ ID NO: 23418 - DNA, 20 bp, Artificial Sequence
  Description of Artificial Sequence: Synthetic oligonucleotide
  Target: ATXN1; (+) strand; PAM type: NNGRRT; PAM sequence: AGGAGT
acggtactggaacaggaatg

SEQ ID NO: 23419 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gtcaagccatttttacttct

SEQ ID NO: 23420 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aagtttagatcacatgagct

SEQ ID NO: 23421 - DNA, 20 bp, Artificial Sequence
  Description of Artificial Sequence: Synthetic oligonucleotide
  Target: ATXN1; (+) strand; PAM type: NNGRRT; PAM sequence: CAGGGT
acccaacatcccattaaaga

SEQ ID NO: 23422 - DNA, 20 bp, Artificial Sequence
  Description of Artificial Sequence: Synthetic oligonucleotide
  Target: ATXN1; (+) strand; PAM type: NNGRRT; PAM sequence: GCGGGT
actttgggaggccgaggtgg

SEQ ID NO: 23423 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggtgggcgggtcacgaggtc

SEQ ID NO: 23424 - DNA, 20 bp, Artificial Sequence
  Description of Artificial Sequence: Synthetic oligonucleotide
  Target: ATXN1; (+) strand; PAM type: NNGRRT; PAM sequence: CCGGGT
actaaaaatacaaacattag

SEQ ID NO: 23425 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgggaggctgaggcag

SEQ ID NO: 23426 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcatgccactgcactccagc

SEQ ID NO: 23427 - DNA, 20 bp, Artificial Sequence
  Description of Artificial Sequence: Synthetic oligonucleotide
  Target: ATXN1; (+) strand; PAM type: NNGRRT; PAM sequence: CAGGAT
caaacaaacaaacaaaaaaa

SEQ ID NO: 23428 - DNA, 20 bp, Artificial Sequence
  Description of Artificial Sequence: Synthetic oligonucleotide
  Target: ATXN1; (+) strand; PAM type: NNGRRT; PAM sequence: AGGAAT
agcaagtctcctatcacaaa

SEQ ID NO: 23429 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gaagaaacaaggacaaggtg

SEQ ID NO: 23430 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tcattcagcacccagtattc

SEQ ID NO: 23431 - DNA, 20 bp, Artificial Sequence
  Description of Artificial Sequence: Synthetic oligonucleotide
  Target: ATXN1; (+) strand; PAM type: NNGRRT; PAM sequence: GTGAAT
acccaaactccaaattcaat

SEQ ID NO: 23432 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gtgcccgtccctaaaatcca

SEQ ID NO: 23433 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tttcttagaagctccctcta

SEQ ID NO: 23434 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agttacttttactggcaata

SEQ ID NO: 23435 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tcacacacaaacaaatgcat

SEQ ID NO: 23436 - DNA, 20 bp, Artificial Sequence
  Description of Artificial Sequence: Synthetic oligonucleotide
  Target: ATXN1; (+) strand; PAM type: NNGRRT; PAM sequence: AGGGGT
taagcttttattttaggttc

SEQ ID NO: 23437 - DNA, 20 bp, Artificial Sequence
  Description of Artificial Sequence: Synthetic oligonucleotide
  Target: ATXN1; (+) strand; PAM type: NNGRRT; PAM sequence: GGGGGT
aatagataaactcatgccat

SEQ ID NO: 23438 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ctgttcccttctttgtgtcc

SEQ ID NO: 23439 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tgttcctgtgatagtttgct

SEQ ID NO: 23440 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gattctgtgtctttgctact

SEQ ID NO: 23441 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gcatgtgtctaaatttatgg

SEQ ID NO: 23442 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gtagaatgatttatattcct

SEQ ID NO: 23443 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tctgggtagatacccagtaa

SEQ ID NO: 23444 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gatacccagtaatgggattg

SEQ ID NO: 23445 - DNA, 20 bp, Artificial Sequence
  Description of Artificial Sequence: Synthetic oligonucleotide
  Target: ATXN1; (+) strand; PAM type: NNGRRT; PAM sequence: TCGAAT
ccagtaatgggattgctggg

SEQ ID NO: 23446 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gttctgcttttagctctttg

SEQ ID NO: 23447 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gtcctttgctcactttttca

SEQ ID NO: 23448 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctccccgcctccccctgagg

SEQ ID NO: 23449 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccgcgtagc

SEQ ID NO: 23450 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tttgtattttttagtagaga

SEQ ID NO: 23451 - DNA, 20 bp, Artificial Sequence
  Description of Artificial Sequence: Synthetic oligonucleotide
  Target: ATXN1; (+) strand; PAM type: NNGRRT; PAM sequence: TGGGAT
accttggcctttcaaagtgc

SEQ ID NO: 23452 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ctgcactttgggaggctgaa

SEQ ID NO: 23453 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggctgaagtgg

SEQ ID NO: 23454 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggtggatcccctgaggtc

SEQ ID NO: 23455 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggaggctgaggcag

SEQ ID NO: 23456 - DNA, 20 bp, Artificial Sequence
  Description of Artificial Sequence: Synthetic oligonucleotide
  Target: ATXN1; (+) strand; PAM type: NNGRRT; PAM sequence: TAGAGT
atttcttaatgttgccttct

SEQ ID NO: 23457 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ataaatcatgtctgtacggg

SEQ ID NO: 23458 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tacgggcagaatcacaaagc

SEQ ID NO: 23459 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ggcagaatcacaaagctaga

SEQ ID NO: 23460 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ttccaactgtgggcattccc

SEQ ID NO: 23461 - DNA, 20 bp, Artificial Sequence
  Description of Artificial Sequence: Synthetic oligonucleotide
  Target: ATXN1; (+) strand; PAM type: NNGRRT; PAM sequence: GGGAGT
aacctgtatctgccctcaag

SEQ ID NO: 23462 - DNA, 20 bp, Artificial Sequence
  Description of Artificial Sequence: Synthetic oligonucleotide
  Target: ATXN1; (+) strand; PAM type: NNGRRT; PAM sequence: GTGAGT
aaaaaaattcaagggcctaa

SEQ ID NO: 23463 - DNA, 20 bp, Artificial Sequence
  Description of Artificial Sequence: Synthetic oligonucleotide
  Target: ATXN1; (+) strand; PAM type: NNGRRT; PAM sequence: GTGGAT
aaattcaagggcctaagtga

SEQ ID NO: 23464 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aaggtgtgcacagacatatg

SEQ ID NO: 23465 - DNA, 20 bp, Artificial Sequence
  Description of Artificial Sequence: Synthetic oligonucleotide
  Target: ATXN1; (+) strand; PAM type: NNGRRT; PAM sequence: GGGGAT
acttagtgggctgatcaaca

SEQ ID NO: 23466 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aagtcatcatctgctcaact

SEQ ID NO: 23467 - DNA, 20 bp, Artificial Sequence
  Description of Artificial Sequence: Synthetic oligonucleotide
  Target: ATXN1; (+) strand; PAM type: NNGRRT; PAM sequence: TAGAAT
actcatgcaatcataaacat

SEQ ID NO: 23468 - DNA, 20 bp, Artificial Sequence
  Description of Artificial Sequence: Synthetic oligonucleotide
  Target: ATXN1; (+) strand; PAM type: NNGRRT; PAM sequence: AGGAAT
taagacgacatggcaataaa

SEQ ID NO: 23469 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aaaaggaatctgttcacaga

SEQ ID NO: 23470 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tctgctatagtgaaaatttc

SEQ ID NO: 23471 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gtttttataatcatgataag

SEQ ID NO: 23472 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tgtgcagcagtcctgtgagg

SEQ ID NO: 23473 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gaggcttaggtcaactttcc

SEQ ID NO: 23474 - DNA, 20 bp, Artificial Sequence
  Description of Artificial Sequence: Synthetic oligonucleotide
  Target: ATXN1; (+) strand; PAM type: NNGRRT; PAM sequence: CTGGAT
aagacgataaattatggagg

SEQ ID NO: 23475 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tatggaggctggatttgaac

SEQ ID NO: 23476 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ggctcaaactctgtggcttc

SEQ ID NO: 23477 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttcatgaatataatgtttca

SEQ ID NO: 23478 - DNA, 20 bp, Artificial Sequence
  Description of Artificial Sequence: Synthetic oligonucleotide
  Target: ATXN1; (+) strand; PAM type: NNGRRT; PAM sequence: ATGGGT
cagtgatcttataagtagaa

SEQ ID NO: 23479 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ctgacacctatatttgcccc

SEQ ID NO: 23480 - DNA, 20 bp, Artificial Sequence
  Description of Artificial Sequence: Synthetic oligonucleotide
  Target: ATXN1; (+) strand; PAM type: NNGRRT; PAM sequence: TTGAAT
atatttgccccttgagtccc

SEQ ID NO: 23481 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tctcactgaaataaagtctc

SEQ ID NO: 23482 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttagttctaattattaaaag

SEQ ID NO: 23483 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tctcagccacaaatcttcat

SEQ ID NO: 23484 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cattagaatggctaatcaat

SEQ ID NO: 23485 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tttcctctgtatgttttttg

SEQ ID NO: 23486 - DNA, 20 bp, Artificial Sequence
  Description of Artificial Sequence: Synthetic oligonucleotide
  Target: ATXN1; (+) strand; PAM type: NNGRRT; PAM sequence: TAGAAT
atgtgatgttagagctggtt

SEQ ID NO: 23487 - DNA, 20 bp, Artificial Sequence
  Description of Artificial Sequence: Synthetic oligonucleotide
  Target: ATXN1; (+) strand; PAM type: NNGRRT; PAM sequence: ATGGAT
catcgtagctatggtggggc

SEQ ID NO: 23488 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aagcaataatgcttacttca

SEQ ID NO: 23489 - DNA, 20 bp, Artificial Sequence
  Description of Artificial Sequence: Synthetic oligonucleotide
  Target: ATXN1; (+) strand; PAM type: NNGRRT; PAM sequence: AGGGGT
cttttcctctctggccagtg

SEQ ID NO: 23490 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tcctctctggccagtgaggg

SEQ ID NO: 23491 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctggggcagtgagacacatc

SEQ ID NO: 23492 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ggaccttgcaacgtttgctc

SEQ ID NO: 23493 - DNA, 20 bp, Artificial Sequence
  Description of Artificial Sequence: Synthetic oligonucleotide
  Target: ATXN1; (+) strand; PAM type: NNGRRT; PAM sequence: GAGGAT
acaccacacagagctgacat

SEQ ID NO: 23494 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgttaggcagaaggaaaaca

SEQ ID NO: 23495 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttgctctccaaagttttgat

SEQ ID NO: 23496 - DNA, 20 bp, Artificial Sequence
  Description of Artificial Sequence: Synthetic oligonucleotide
  Target: ATXN1; (+) strand; PAM type: NNGRRT; PAM sequence: CAGAAT
caagattcttgtcaatgacc

SEQ ID NO: 23497 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gccagatcatgaagccccac

SEQ ID NO: 23498 - DNA, 20 bp, Artificial Sequence
  Description of Artificial Sequence: Synthetic oligonucleotide
  Target: ATXN1; (+) strand; PAM type: NNGRRT; PAM sequence: CGGGGT
catgaagccccactgggatg

SEQ ID NO: 23499 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gatgcggggttgggggctgt

SEQ ID NO: 23500 - DNA, 20 bp, Artificial Sequence
  Description of Artificial Sequence: Synthetic oligonucleotide
  Target: ATXN1; (+) strand; PAM type: NNGRRT; PAM sequence: GGGGGT
agtgctccaaaagccaggag

SEQ ID NO: 23501 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaaaaaaaatgcaaaaaac

SEQ ID NO: 23502 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cagcactttaggaggcagag

SEQ ID NO: 23503 - DNA, 20 bp, Artificial Sequence
  Description of Artificial Sequence: Synthetic oligonucleotide
  Target: ATXN1; (+) strand; PAM type: NNGRRT; PAM sequence: ATGGAT
actttaggaggcagaggtga

SEQ ID NO: 23504 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tgaatggatcacctgaggtc

SEQ ID NO: 23505 - DNA, 20 bp, Artificial Sequence
  Description of Artificial Sequence: Synthetic oligonucleotide
  Target: ATXN1; (+) strand; PAM type: NNGRRT; PAM sequence: CCGGGT
taataacacaaaaaaattag

SEQ ID NO: 23506 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggaggctgagacag

SEQ ID NO: 23507 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gtgaaattgttaagacaatt

SEQ ID NO: 23508 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tacttcataagattctcttg

SEQ ID NO: 23509 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aacatgaccacacgacccat

SEQ ID NO: 23510 - DNA, 20 bp, Artificial Sequence
  Description of Artificial Sequence: Synthetic oligonucleotide
  Target: ATXN1; (+) strand; PAM type: NNGRRT; PAM sequence: CTGAGT
atctgcagcctcaaagggag

SEQ ID NO: 23511 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ccctgaggttcctgccttgc

SEQ ID NO: 23512 - DNA, 20 bp, Artificial Sequence
  Description of Artificial Sequence: Synthetic oligonucleotide
  Target: ATXN1; (+) strand; PAM type: NNGRRT; PAM sequence: GAGGAT
acatctcacaggttgtccag

SEQ ID NO: 23513 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tgatagtgacagctcaaggc

SEQ ID NO: 23514 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tttacttagcaagcactacc

SEQ ID NO: 23515 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ctcggttttctcatctgtag

SEQ ID NO: 23516 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ggataatactccctacctca

SEQ ID NO: 23517 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacctcatagggttgtttct

SEQ ID NO: 23518 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ccaaactaacttctgtctct

SEQ ID NO: 23519 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tttgcgtgtgtgtgtgtgag

SEQ ID NO: 23520 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gtgaggaggatacatatttc

SEQ ID NO: 23521 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ggatacatatttcatgagtg

SEQ ID NO: 23522 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tgattattaagctctagagc

SEQ ID NO: 23523 - DNA, 20 bp, Artificial Sequence
  Description of Artificial Sequence: Synthetic oligonucleotide
  Target: ATXN1; (+) strand; PAM type: NNGRRT; PAM sequence: GCGAAT
caacaggaggtgagcagtag

SEQ ID NO: 23524 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tattgtgaactgcacatgtg

SEQ ID NO: 23525 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gtaggttgcaccctctttat

SEQ ID NO: 23526 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tgttgcaggaaaacaagctc

SEQ ID NO: 23527 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ctcactgattctacattatg

SEQ ID NO: 23528 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taatataaataaagtgcaca

SEQ ID NO: 23529 - DNA, 20 bp, Artificial Sequence
  Description of Artificial Sequence: Synthetic oligonucleotide
  Target: ATXN1; (+) strand; PAM type: NNGRRT; PAM sequence: TTGAAT
cacaatgaatataaatgcat

SEQ ID NO: 23530 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ttacacactgcccagaaact

SEQ ID NO: 23531 - DNA, 20 bp, Artificial Sequence
  Description of Artificial Sequence: Synthetic oligonucleotide
  Target: ATXN1; (+) strand; PAM type: NNGRRT; PAM sequence: GTGAGT
acaaaagctcattcatatgt

SEQ ID NO: 23532 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gaccagataaataaatatgt

SEQ ID NO: 23533 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tccaaaagcatcctgaaaac

SEQ ID NO: 23534 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ccgtggagatcaccgaacac

SEQ ID NO: 23535 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gctgaagggaaggaacctcc

SEQ ID NO: 23536 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gcagcccttcactgtggctg

SEQ ID NO: 23537 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cactgtggctgctgagtcat

SEQ ID NO: 23538 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ctgggacaggccctcatgtc

SEQ ID NO: 23539 - DNA, 20 bp, Artificial Sequence
  Description of Artificial Sequence: Synthetic oligonucleotide
  Target: ATXN1; (+) strand; PAM type: NNGRRT; PAM sequence: CTGAAT
catgacaactgtcattcgcc

SEQ ID NO: 23540 - DNA, 20 bp, Artificial Sequence
  Description of Artificial Sequence: Synthetic oligonucleotide
  Target: ATXN1; (+) strand; PAM type: NNGRRT; PAM sequence: ATGAAT
agtgactaataaatggtatc

SEQ ID NO: 23541 - DNA, 20 bp, Artificial Sequence
  Description of Artificial Sequence: Synthetic oligonucleotide
  Target: ATXN1; (+) strand; PAM type: NNGRRT; PAM sequence: TGGGAT
attcctcagttatattttct

SEQ ID NO: 23542 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tcaacaggaaatgtcatagc

SEQ ID NO: 23543 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tttacacctaacgacggcct

SEQ ID NO: 23544 - DNA, 20 bp, Artificial Sequence
  Description of Artificial Sequence: Synthetic oligonucleotide
  Target: ATXN1; (+) strand; PAM type: NNGRRT; PAM sequence: AAGGAT
agacagtgtggcgattcctc

SEQ ID NO: 23545 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gacccagccatcccattact

SEQ ID NO: 23546 - DNA, 20 bp, Artificial Sequence
  Description of Artificial Sequence: Synthetic oligonucleotide
  Target: ATXN1; (+) strand; PAM type: NNGRRT; PAM sequence: AAGGAT
cattactggggatataccca

SEQ ID NO: 23547 - DNA, 20 bp, Artificial Sequence
  Description of Artificial Sequence: Synthetic oligonucleotide
  Target: ATXN1; (+) strand; PAM type: NNGRRT; PAM sequence: CTGGAT
aaatgtccatcaatgataga

SEQ ID NO: 23548 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aatgtggcacatatacacca

SEQ ID NO: 23549 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aatactatgtagccataaaa

SEQ ID NO: 23550 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ctatgtagccataaaaaagg

SEQ ID NO: 23551 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ttcatgtcctttgttgggac

SEQ ID NO: 23552 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gcatgttctcactcataggt

SEQ ID NO: 23553 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tcgcacaccggggcctgtca

SEQ ID NO: 23554 - DNA, 20 bp, Artificial Sequence
  Description of Artificial Sequence: Synthetic oligonucleotide
  Target: ATXN1; (+) strand; PAM type: NNGRRT; PAM sequence: ATGAGT
agatatacctaatgtaaatg

SEQ ID NO: 23555 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ctaatgtaaatgatgagtta

SEQ ID NO: 23556 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tcaacagctgtttctccaat

SEQ ID NO: 23557 - DNA, 20 bp, Artificial Sequence
  Description of Artificial Sequence: Synthetic oligonucleotide
  Target: ATXN1; (+) strand; PAM type: NNGRRT; PAM sequence: GTGAAT
attagagtcacctataacaa

SEQ ID NO: 23558 - DNA, 20 bp, Artificial Sequence
  Description of Artificial Sequence: Synthetic oligonucleotide
  Target: ATXN1; (+) strand; PAM type: NNGRRT; PAM sequence: TCGAGT
atcaccttaaaatatccatg

SEQ ID NO: 23559 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tagctattaaattaattttc

SEQ ID NO: 23560 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ggggcgattcccagaaatat

SEQ ID NO: 23561 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttgtgggctagcagattttt

SEQ ID NO: 23562 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gtttaaacatattcataatc

SEQ ID NO: 23563 - DNA, 20 bp, Artificial Sequence
  Description of Artificial Sequence: Synthetic oligonucleotide
  Target: ATXN1; (+) strand; PAM type: NNGRRT; PAM sequence: GTGGAT
aaacatattcataatcaggg

SEQ ID NO: 23564 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gcagtttataaaactagtca

SEQ ID NO: 23565 - DNA, 20 bp, Artificial Sequence
  Description of Artificial Sequence: Synthetic oligonucleotide
  Target: ATXN1; (+) strand; PAM type: NNGRRT; PAM sequence: AGGAGT
taaaactagtcaaggggtag

SEQ ID NO: 23566 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aaggggtagaggagtgtgta

SEQ ID NO: 23567 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gaggagtgtgtatggggtgt

SEQ ID NO: 23568 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aactttgggaggctgaagtg

SEQ ID NO: 23569 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gtggaggatcgcttgagccc

SEQ ID NO: 23570 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tactcagaaggctcaggtgg

SEQ ID NO: 23571 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tcacaacactgcaatccagc

SEQ ID NO: 23572 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tatcaacataaaattaggta

SEQ ID NO: 23573 - DNA, 20 bp, Artificial Sequence
  Description of Artificial Sequence: Synthetic oligonucleotide
  Target: ATXN1; (+) strand; PAM type: NNGRRT; PAM sequence: CTGAGT
cactttagtatacatttttg

SEQ ID NO: 23574 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttatgttgtcgagctgttaa

SEQ ID NO: 23575 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ggtgaagccagctggacttc

SEQ ID NO: 23576 - DNA, 20 bp, Artificial Sequence
  Description of Artificial Sequence: Synthetic oligonucleotide
  Target: ATXN1; (+) strand; PAM type: NNGRRT; PAM sequence: TCGAGT
agccagctggacttcttggg

SEQ ID NO: 23577 - DNA, 20 bp, Artificial Sequence
  Description of Artificial Sequence: Synthetic oligonucleotide
  Target: ATXN1; (+) strand; PAM type: NNGRRT; PAM sequence: GGGGAT
agaacttttctgtcttacaa

SEQ ID NO: 23578 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ggggattgtaaaatgcacca

SEQ ID NO: 23579 - DNA, 20 bp, Artificial Sequence
  Description of Artificial Sequence: Synthetic oligonucleotide
  Target: ATXN1; (+) strand; PAM type: NNGRRT; PAM sequence: TAGAAT
atggaccaatcagtgctctg

SEQ ID NO: 23580 - DNA, 20 bp, Artificial Sequence
  Description of Artificial Sequence: Synthetic oligonucleotide
  Target: ATXN1; (+) strand; PAM type: NNGRRT; PAM sequence: GGGAAT
acatgggcagggacaaataa

SEQ ID NO: 23581 - DNA, 20 bp, Artificial Sequence
  Description of Artificial Sequence: Synthetic oligonucleotide
  Target: ATXN1; (+) strand; PAM type: NNGRRT; PAM sequence: TCGGGT
agccagcagagacaacccgc

SEQ ID NO: 23582 - DNA, 20 bp, Artificial Sequence
  Description of Artificial Sequence: Synthetic oligonucleotide
  Target: ATXN1; (+) strand; PAM type: NNGRRT; PAM sequence: TTGGGT
atcttgctactgctcgctct

SEQ ID NO: 23583 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagccgcctaagtagc

SEQ ID NO: 23584 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtagaga

SEQ ID NO: 23585 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcttcccaaggtgc

SEQ ID NO: 23586 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tgagccattgcgcccggccc

SEQ ID NO: 23587 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctcattaaagatgtaaatag

SEQ ID NO: 23588 - DNA, 20 bp, Artificial Sequence
  Description of Artificial Sequence: Synthetic oligonucleotide
  Target: ATXN1; (+) strand; PAM type: NNGRRT; PAM sequence: CTGAGT
cagaaagaaatacttcttct

SEQ ID NO: 23589 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctccttgtttcctcagacac

SEQ ID NO: 23590 - DNA, 20 bp, Artificial Sequence
  Description of Artificial Sequence: Synthetic oligonucleotide
  Target: ATXN1; (+) strand; PAM type: NNGRRT; PAM sequence: ACGAGT
gaggccaaggtgggcagatc

SEQ ID NO: 23591 - DNA, 20 bp, Artificial Sequence
  Description of Artificial Sequence: Synthetic oligonucleotide
  Target: ATXN1; (+) strand; PAM type: NNGRRT; PAM sequence: GCGGGT
aaagttagccggacgtagtg

SEQ ID NO: 23592 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tattcgggaggctgaggcag

SEQ ID NO: 23593 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcgtgccactgcactcaagc

SEQ ID NO: 23594 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctcaaaaaagaaaaaaaaaa

SEQ ID NO: 23595 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctaagcattcaagtgaaagg

SEQ ID NO: 23596 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gcattcaagtgaaaggaaga

SEQ ID NO: 23597 - DNA, 20 bp, Artificial Sequence
  Description of Artificial Sequence: Synthetic oligonucleotide
  Target: ATXN1; (+) strand; PAM type: NNGRRT; PAM sequence: AAGGGT
agccaggcttcttgtgactg

SEQ ID NO: 23598 - DNA, 20 bp, Artificial Sequence
  Description of Artificial Sequence: Synthetic oligonucleotide
  Target: ATXN1; (+) strand; PAM type: NNGRRT; PAM sequence: GTGAAT
actgaagggttagccaagct

SEQ ID NO: 23599 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gttgctgatatggacaaagt

SEQ ID NO: 23600 - DNA, 20 bp, Artificial Sequence
  Description of Artificial Sequence: Synthetic oligonucleotide
  Target: ATXN1; (+) strand; PAM type: NNGRRT; PAM sequence: CTGAAT
atggacaaagttagagtggt

SEQ ID NO: 23601 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctagagccctaataattatg

SEQ ID NO: 23602 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tagaaatggaacaacaaagc

SEQ ID NO: 23603 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aaagcctggatgaaagcaca

SEQ ID NO: 23604 - DNA, 20 bp, Artificial Sequence
  Description of Artificial Sequence: Synthetic oligonucleotide
  Target: ATXN1; (+) strand; PAM type: NNGRRT; PAM sequence: ATGGAT
caacacccattctgcaaccc

SEQ ID NO: 23605 - DNA, 20 bp, Artificial Sequence
  Description of Artificial Sequence: Synthetic oligonucleotide
  Target: ATXN1; (+) strand; PAM type: NNGRRT; PAM sequence: AGGAGT
attctgcaacccatggatca

SEQ ID NO: 23606 - DNA, 20 bp, Artificial Sequence
  Description of Artificial Sequence: Synthetic oligonucleotide
  Target: ATXN1; (+) strand; PAM type: NNGRRT; PAM sequence: ATGGAT
cacagaaagtaattcctctg

SEQ ID NO: 23607 - DNA, 20 bp, Artificial Sequence
  Description of Artificial Sequence: Synthetic oligonucleotide
  Target: ATXN1; (+) strand; PAM type: NNGRRT; PAM sequence: AAGGAT
taaattgaaaacctcctgga

SEQ ID NO: 23608 - DNA, 20 bp, Artificial Sequence
  Description of Artificial Sequence: Synthetic oligonucleotide
  Target: ATXN1; (+) strand; PAM type: NNGRRT; PAM sequence: ATGGAT
agaagttgattccaaccccc

SEQ ID NO: 23609 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ccaacccccatggatgactt

SEQ ID NO: 23610 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ggtggaaacagcaagagaac

SEQ ID NO: 23611 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aatggagcctgaaaatgtga

SEQ ID NO: 23612 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgatcaaacttcagcagatg

SEQ ID NO: 23613 - DNA, 20 bp, Artificial Sequence
  Description of Artificial Sequence: Synthetic oligonucleotide
  Target: ATXN1; (+) strand; PAM type: NNGRRT; PAM sequence: GGGAAT
actttgggaggccgaggcag

SEQ ID NO: 23614 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcag

SEQ ID NO: 23615 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcgcgccactgcactccagc

SEQ ID NO: 23616 - DNA, 20 bp, Artificial Sequence
  Description of Artificial Sequence: Synthetic oligonucleotide
  Target: ATXN1; (+) strand; PAM type: NNGRRT; PAM sequence: AAGGAT
acactgttaaaatgacaaca

SEQ ID NO: 23617 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ctaactttgaaagttctact

SEQ ID NO: 23618 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gagaaatctttcatgaaagg

SEQ ID NO: 23619 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tttgtttagacaaaatgtta

SEQ ID NO: 23620 - DNA, 20 bp, Artificial Sequence
  Description of Artificial Sequence: Synthetic oligonucleotide
  Target: ATXN1; (+) strand; PAM type: NNGRRT; PAM sequence: CTGAGT
taagtgaacccaaaatatct

SEQ ID NO: 23621 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cagcactttgggaggctgag

SEQ ID NO: 23622 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggctgaggtgg

SEQ ID NO: 23623 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gctgaggtgggtggatcacc

SEQ ID NO: 23624 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgggtggatcacctggggtc

SEQ ID NO: 23625 - DNA, 20 bp, Artificial Sequence
  Description of Artificial Sequence: Synthetic oligonucleotide
  Target: ATXN1; (+) strand; PAM type: NNGRRT; PAM sequence: ACGGGT
cagcactttgagaggccaag

SEQ ID NO: 23626 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggtagactgcttgagccc

SEQ ID NO: 23627 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgcactccagcctgggagac

SEQ ID NO: 23628 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctgcttgcagaaattctgag

SEQ ID NO: 23629 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gagaagaattcgggccaaat

SEQ ID NO: 23630 - DNA, 20 bp, Artificial Sequence
  Description of Artificial Sequence: Synthetic oligonucleotide
  Target: ATXN1; (+) strand; PAM type: NNGRRT; PAM sequence: AAGAGT
acatgaaactatgtctcaga

SEQ ID NO: 23631 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tacaacccagtttctgaaat

SEQ ID NO: 23632 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gttaccaggggctgggagga

SEQ ID NO: 23633 - DNA, 20 bp, Artificial Sequence
  Description of Artificial Sequence: Synthetic oligonucleotide
  Target: ATXN1; (+) strand; PAM type: NNGRRT; PAM sequence: TGGAGT
caggggctgggaggagagaa

SEQ ID NO: 23634 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gaatggagtgttattgtcta

SEQ ID NO: 23635 - DNA, 20 bp, Artificial Sequence
  Description of Artificial Sequence: Synthetic oligonucleotide
  Target: ATXN1; (+) strand; PAM type: NNGRRT; PAM sequence: CGGGAT
atgaatgcagagcttctgtt

SEQ ID NO: 23636 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atgatgaaaaagttctggaa

SEQ ID NO: 23637 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tggaaatgtacataatgcca

SEQ ID NO: 23638 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgggaggccgaggcag

SEQ ID NO: 23639 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aatcaaattaaggacacttt

SEQ ID NO: 23640 - DNA, 20 bp, Artificial Sequence
  Description of Artificial Sequence: Synthetic oligonucleotide
  Target: ATXN1; (+) strand; PAM type: NNGRRT; PAM sequence: TAGGGT
aattaaggacactttcagag

SEQ ID NO: 23641 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ctttcagagtagggtatctg

SEQ ID NO: 23642 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ctctatgctggctctccaaa

SEQ ID NO: 23643 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gctggctctccaaagtgggt

SEQ ID NO: 23644 - DNA, 20 bp, Artificial Sequence
  Description of Artificial Sequence: Synthetic oligonucleotide
  Target: ATXN1; (+) strand; PAM type: NNGRRT; PAM sequence: AGGGAT
gagtggtgccaggaacggga

SEQ ID NO: 23645 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ctctgaaaatcagcactagc

SEQ ID NO: 23646 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gtgtcttttagataataaac

SEQ ID NO: 23647 - DNA, 20 bp, Artificial Sequence
  Description of Artificial Sequence: Synthetic oligonucleotide
  Target: ATXN1; (+) strand; PAM type: NNGRRT; PAM sequence: TAGGGT
aagtgcttgccccaaatatc

SEQ ID NO: 23648 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cccaaactgcatctactgtg

SEQ ID NO: 23649 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctttgcattctgacccaatg

SEQ ID NO: 23650 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctgccagcagcatcatttag

SEQ ID NO: 23651 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tttaacctctgcaaagtaga

SEQ ID NO: 23652 - DNA, 20 bp, Artificial Sequence
  Description of Artificial Sequence: Synthetic oligonucleotide
  Target: ATXN1; (+) strand; PAM type: NNGRRT; PAM sequence: AGGGGT
aagagaggttcaatagaggg

SEQ ID NO: 23653 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gtggtggccgactacagacc

SEQ ID NO: 23654 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aagggtgagggagccacaga

SEQ ID NO: 23655 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ctacctttaagatttcctat

SEQ ID NO: 23656 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgaaacatgcacaggcaaaa

SEQ ID NO: 23657 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aattgtacaaaacatgtttc

SEQ ID NO: 23658 - DNA, 20 bp, Artificial Sequence
  Description of Artificial Sequence: Synthetic oligonucleotide
  Target: ATXN1; (+) strand; PAM type: NNGRRT; PAM sequence: TGGAGT
acagactccaccagtattta

SEQ ID NO: 23659 - DNA, 20 bp, Artificial Sequence
  Description of Artificial Sequence: Synthetic oligonucleotide
  Target: ATXN1; (+) strand; PAM type: NNGRRT; PAM sequence: CAGGAT
taccactcctctggggagcc

SEQ ID NO: 23660 - DNA, 20 bp, Artificial Sequence
  Description of Artificial Sequence: Synthetic oligonucleotide
  Target: ATXN1; (+) strand; PAM type: NNGRRT; PAM sequence: GAGAAT
actctgagaggccaaagcag

SEQ ID NO: 23661 - DNA, 20 bp, Artificial Sequence
  Description of Artificial Sequence: Synthetic oligonucleotide
  Target: ATXN1; (+) strand; PAM type: NNGRRT; PAM sequence: CTGGGT
acacagggctccagaacagc

SEQ ID NO: 23662 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aacagcctgggtaacatagc

SEQ ID NO: 23663 - DNA, 20 bp, Artificial Sequence
  Description of Artificial Sequence: Synthetic oligonucleotide
  Target: ATXN1; (+) strand; PAM type: NNGRRT; PAM sequence: TGGGGT
attccagagctctgggaagt

SEQ ID NO: 23664 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gctctgggaagttggggtgg

SEQ ID NO: 23665 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tcacctgggctcaggaggtc

SEQ ID NO: 23666 - DNA, 20 bp, Artificial Sequence
  Description of Artificial Sequence: Synthetic oligonucleotide
  Target: ATXN1; (+) strand; PAM type: NNGRRT; PAM sequence: CTGGGT
atgataccactgtactcagc

SEQ ID NO: 23667 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cagataagtaaattcctgct

SEQ ID NO: 23668 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ctccgccacttaagaaaaaa

SEQ ID NO: 23669 - DNA, 20 bp, Artificial Sequence
  Description of Artificial Sequence: Synthetic oligonucleotide
  Target: ATXN1; (+) strand; PAM type: NNGRRT; PAM sequence: GTGGAT
cattttctcatctgtaaaat

SEQ ID NO: 23670 - DNA, 20 bp, Artificial Sequence
  Description of Artificial Sequence: Synthetic oligonucleotide
  Target: ATXN1; (+) strand; PAM type: NNGRRT; PAM sequence: GGGAGT
atgtggatagctatgttgaa

SEQ ID NO: 23671 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tttatgtaaagccccaacca

SEQ ID NO: 23672 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ctgatatatggcaccactca

SEQ ID NO: 23673 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgggcacacgccctcccgtg

SEQ ID NO: 23674 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttgctcccagctctgtcagg

SEQ ID NO: 23675 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cattgcttcgccttccctag

SEQ ID NO: 23676 - DNA, 20 bp, Artificial Sequence
  Description of Artificial Sequence: Synthetic oligonucleotide
  Target: ATXN1; (+) strand; PAM type: NNGRRT; PAM sequence: AAGAAT
caagtttgtaggaaggcatg

SEQ ID NO: 23677 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tggaaaaattttaccacaaa

SEQ ID NO: 23678 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tctcgctctgtcacccaggc

SEQ ID NO: 23679 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttatatttttagtagaga

SEQ ID NO: 23680 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tggggtttcaccatattggc

SEQ ID NO: 23681 - DNA, 20 bp, Artificial Sequence
  Description of Artificial Sequence: Synthetic oligonucleotide
  Target: ATXN1; (+) strand; PAM type: NNGRRT; PAM sequence: TGGGAT
accatggcctcccaaagtgc

SEQ ID NO: 23682 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tgttttatttttcttatttc

SEQ ID NO: 23683 - DNA, 20 bp, Artificial Sequence
  Description of Artificial Sequence: Synthetic oligonucleotide
  Target: ATXN1; (+) strand; PAM type: NNGRRT; PAM sequence: GGGGAT
attttaaatctttgagatct

SEQ ID NO: 23684 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aaatctttgagatctgggga

SEQ ID NO: 23685 - DNA, 20 bp, Artificial Sequence
  Description of Artificial Sequence: Synthetic oligonucleotide
  Target: ATXN1; (+) strand; PAM type: NNGRRT; PAM sequence: ACGGGT
cagcactttgggaggctgag

SEQ ID NO: 23686 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggctgagacgg

SEQ ID NO: 23687 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggtggatcatctgaggtc

SEQ ID NO: 23688 - DNA, 20 bp, Artificial Sequence
  Description of Artificial Sequence: Synthetic oligonucleotide
  Target: ATXN1; (+) strand; PAM type: NNGRRT; PAM sequence: CTGGGT
actaaaaatacaaaaattat

SEQ ID NO: 23689 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aataaaataaaataaaactt

SEQ ID NO: 23690 - DNA, 20 bp, Artificial Sequence
  Description of Artificial Sequence: Synthetic oligonucleotide
  Target: ATXN1; (+) strand; PAM type: NNGRRT; PAM sequence: GAGGGT
caacactaggcaaccttgga

SEQ ID NO: 23691 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gtcatagtctaattgccttc

SEQ ID NO: 23692 - DNA, 20 bp, Artificial Sequence
  Description of Artificial Sequence: Synthetic oligonucleotide
  Target: ATXN1; (+) strand; PAM type: NNGRRT; PAM sequence: TAGGAT
agtttttgtcactaggtact

SEQ ID NO: 23693 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aatatagtcagtacctcctg

SEQ ID NO: 23694 - DNA, 20 bp, Artificial Sequence
  Description of Artificial Sequence: Synthetic oligonucleotide
  Target: ATXN1; (+) strand; PAM type: NNGRRT; PAM sequence: CAGAAT
caaccccatggctagtgcaa

SEQ ID NO: 23695 - DNA, 20 bp, Artificial Sequence
  Description of Artificial Sequence: Synthetic oligonucleotide
  Target: ATXN1; (+) strand; PAM type: NNGRRT; PAM sequence: GGGAGT
agaatagctaaagggaaact

SEQ ID NO: 23696 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tagccatggtatatttcatg

SEQ ID NO: 23697 - DNA, 20 bp, Artificial Sequence
  Description of Artificial Sequence: Synthetic oligonucleotide
  Target: ATXN1; (+) strand; PAM type: NNGRRT; PAM sequence: AAGGGT
atggatcttgtaaacagctg

SEQ ID NO: 23698 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ctgaagggtcaggtttttaa

SEQ ID NO: 23699 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ctttactctgcaaaacagac

SEQ ID NO: 23700 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atgaaatgctaaaaaatgat

SEQ ID NO: 23701 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agccttcataaaattccatt

SEQ ID NO: 23702 - DNA, 20 bp, Artificial Sequence
  Description of Artificial Sequence: Synthetic oligonucleotide
  Target: ATXN1; (+) strand; PAM type: NNGRRT; PAM sequence: CCGAAT
tggaaagaacttttgaggag

SEQ ID NO: 23703 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cttttggtattttagccaaa

SEQ ID NO: 23704 - DNA, 20 bp, Artificial Sequence
  Description of Artificial Sequence: Synthetic oligonucleotide
  Target: ATXN1; (+) strand; PAM type: NNGRRT; PAM sequence: CAGAGT
taacaagtatattcctagag

SEQ ID NO: 23705 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cctagagcagagtagccttt

SEQ ID NO: 23706 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ttcacaaaatgtggccagaa

SEQ ID NO: 23707 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gaactggatgtgtcatttat

SEQ ID NO: 23708 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gaagcaattctatctgatgt

SEQ ID NO: 23709 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttagtttaaatgatgtgagg

SEQ ID NO: 23710 - DNA, 20 bp, Artificial Sequence
  Description of Artificial Sequence: Synthetic oligonucleotide
  Target: ATXN1; (+) strand; PAM type: NNGRRT; PAM sequence: AAGGAT
catttttaatatcttacctg

SEQ ID NO: 23711 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tattaaactgtattatatgc

SEQ ID NO: 23712 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gcaggaatgggcttaacact

SEQ ID NO: 23713 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ataagtcaatttctgtcttc

SEQ ID NO: 23714 - DNA, 20 bp, Artificial Sequence
  Description of Artificial Sequence: Synthetic oligonucleotide
  Target: ATXN1; (+) strand; PAM type: NNGRRT; PAM sequence: GAGGAT
taatagcggtaacacagcaa

SEQ ID NO: 23715 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctctatctgttgcccaggc

SEQ ID NO: 23716 - DNA, 20 bp, Artificial Sequence
  Description of Artificial Sequence: Synthetic oligonucleotide
  Target: ATXN1; (+) strand; PAM type: NNGRRT; PAM sequence: TGGAAT
atctgttgcccaggctggag

SEQ ID NO: 23717 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtgagacaccatgcttggcc

SEQ ID NO: 23718 - DNA, 20 bp, Artificial Sequence
  Description of Artificial Sequence: Synthetic oligonucleotide
  Target: ATXN1; (+) strand; PAM type: NNGRRT; PAM sequence: ACGAAT
ggaatttcaattaggcctca

SEQ ID NO: 23719 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tttcaattaggcctcaacga

SEQ ID NO: 23720 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ttaggcctcaacgaatgagt

SEQ ID NO: 23721 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gagtttaccaggcagagaac

SEQ ID NO: 23722 - DNA, 20 bp, Artificial Sequence
  Description of Artificial Sequence: Synthetic oligonucleotide
  Target: ATXN1; (+) strand; PAM type: NNGRRT; PAM sequence: AGGGAT
atattatatggagagatgga

SEQ ID NO: 23723 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tatggagagatggaagggat

SEQ ID NO: 23724 - DNA, 20 bp, Artificial Sequence
  Description of Artificial Sequence: Synthetic oligonucleotide
  Target: ATXN1; (+) strand; PAM type: NNGRRT; PAM sequence: AGGAAT
atttaaatggtaagttgata

SEQ ID NO: 23725 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ccatattcatttgctaccaa

SEQ ID NO: 23726 - DNA, 20 bp, Artificial Sequence
  Description of Artificial Sequence: Synthetic oligonucleotide
  Target: ATXN1; (+) strand; PAM type: NNGRRT; PAM sequence: ATGAAT
attaaaaaacacacacacac

SEQ ID NO: 23727 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tttctttacttctagccttt

SEQ ID NO: 23728 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgtttgcacaattttgaaat

SEQ ID NO: 23729 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aattttatacttaacatttg

SEQ ID NO: 23730 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tgcagtgaaccgtaacctac

SEQ ID NO: 23731 - DNA, 20 bp, Artificial Sequence
  Description of Artificial Sequence: Synthetic oligonucleotide
  Target: ATXN1; (+) strand; PAM type: NNGRRT; PAM sequence: CTGGGT
acctattcttgtaccaatct

SEQ ID NO: 23732 - DNA, 20 bp, Artificial Sequence
  Description of Artificial Sequence: Synthetic oligonucleotide
  Target: ATXN1; (+) strand; PAM type: NNGRRT; PAM sequence: GCGAAT
gtaccaatctctgggtttcg

SEQ ID NO: 23733 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aacagcatgtcagaaatgcc

SEQ ID NO: 23734 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ctattctagttcgggaggaa

SEQ ID NO: 23735 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gatttgcaaatagttctttg

SEQ ID NO: 23736 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ttcttttaacacattagatt

SEQ ID NO: 23737 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ccatatttccacatactacc

SEQ ID NO: 23738 - DNA, 20 bp, Artificial Sequence
  Description of Artificial Sequence: Synthetic oligonucleotide
  Target: ATXN1; (+) strand; PAM type: NNGRRT; PAM sequence: AGGAGT
taccaaggattttcaagtgt

SEQ ID NO: 23739 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tcagaccctttctttcatat

SEQ ID NO: 23740 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tttcatatgagaattctcaa

SEQ ID NO: 23741 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tatgagaattctcaaaagag

SEQ ID NO: 23742 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ctgcaacagaacaggggccc

SEQ ID NO: 23743 - DNA, 20 bp, Artificial Sequence
  Description of Artificial Sequence: Synthetic oligonucleotide
  Target: ATXN1; (+) strand; PAM type: NNGRRT; PAM sequence: AAGAGT
acaggggcccgagagtggag

SEQ ID NO: 23744 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gggcccgagagtggagaaga

SEQ ID NO: 23745 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggcttaggcag

SEQ ID NO: 23746 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggcaggcggatcatgaggtc

SEQ ID NO: 23747 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcag

SEQ ID NO: 23748 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tggtgccactgcactccagc

SEQ ID NO: 23749 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agaactccagcatatgagct

SEQ ID NO: 23750 - DNA, 20 bp, Artificial Sequence
  Description of Artificial Sequence: Synthetic oligonucleotide
  Target: ATXN1; (+) strand; PAM type: NNGRRT; PAM sequence: TGGAGT
acacctatgtgatatccagc

SEQ ID NO: 23751 - DNA, 20 bp, Artificial Sequence
  Description of Artificial Sequence: Synthetic oligonucleotide
  Target: ATXN1; (+) strand; PAM type: NNGRRT; PAM sequence: CAGAGT
agaaatactagttgtgtgtg

SEQ ID NO: 23752 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aagaaagtacattgcatttc

SEQ ID NO: 23753 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aagtacattgcatttcctga

SEQ ID NO: 23754 - DNA, 20 bp, Artificial Sequence
  Description of Artificial Sequence: Synthetic oligonucleotide
  Target: ATXN1; (+) strand; PAM type: NNGRRT; PAM sequence: ACGAGT
tgatagcatcagcaagagga

SEQ ID NO: 23755 - DNA, 20 bp, Artificial Sequence
  Description of Artificial Sequence: Synthetic oligonucleotide
  Target: ATXN1; (+) strand; PAM type: NNGRRT; PAM sequence: TTGGGT
cacatttaacaaaaggcatt

SEQ ID NO: 23756 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ttctaacgatggtctttagt

SEQ ID NO: 23757 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ttggaaatcatgtacctctc

SEQ ID NO: 23758 - DNA, 20 bp, Artificial Sequence
  Description of Artificial Sequence: Synthetic oligonucleotide
  Target: ATXN1; (+) strand; PAM type: NNGRRT; PAM sequence: TAGAAT
taactagacaaatgctcttt

SEQ ID NO: 23759 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tttttttctgttttcctacc

SEQ ID NO: 23760 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cttttttccttcacttagat

SEQ ID NO: 23761 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cacttagatgagaatttgag

SEQ ID NO: 23762 - DNA, 20 bp, Artificial Sequence
  Description of Artificial Sequence: Synthetic oligonucleotide
  Target: ATXN1; (+) strand; PAM type: NNGRRT; PAM sequence: CTGAAT
caaacctcctttagtcaaaa

SEQ ID NO: 23763 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgcttgctttttcacacaaa

SEQ ID NO: 23764 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tttttcacacaaactgaatt

SEQ ID NO: 23765 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tctaggctagctaagcttct

SEQ ID NO: 23766 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gcttctgtgagttcttctgt

SEQ ID NO: 23767 - DNA, 20 bp, Artificial Sequence
  Description of Artificial Sequence: Synthetic oligonucleotide
  Target: ATXN1; (+) strand; PAM type: NNGRRT; PAM sequence: CTGGAT
caacgccctgcaaatctctc

SEQ ID NO: 23768 - DNA, 20 bp, Artificial Sequence
  Description of Artificial Sequence: Synthetic oligonucleotide
  Target: ATXN1; (+) strand; PAM type: NNGRRT; PAM sequence: TTGGAT
accactgcagtctgctaaca

SEQ ID NO: 23769 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gctaacattggattcaaatc

SEQ ID NO: 23770 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cagctgaaagaaataccact

SEQ ID NO: 23771 - DNA, 20 bp, Artificial Sequence
  Description of Artificial Sequence: Synthetic oligonucleotide
  Target: ATXN1; (+) strand; PAM type: NNGRRT; PAM sequence: AAGGGT
accactcagaataaactgcc

SEQ ID NO: 23772 - DNA, 20 bp, Artificial Sequence
  Description of Artificial Sequence: Synthetic oligonucleotide
  Target: ATXN1; (+) strand; PAM type: NNGRRT; PAM sequence: AAGGAT
caggtgtggctttgggagcc

SEQ ID NO: 23773 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gctcctgtcattaccaccaa

SEQ ID NO: 23774 - DNA, 20 bp, Artificial Sequence
  Description of Artificial Sequence: Synthetic oligonucleotide
  Target: ATXN1; (+) strand; PAM type: NNGRRT; PAM sequence: GTGGGT
ctttacgtatttggaagaaa

SEQ ID NO: 23775 - DNA, 20 bp, Artificial Sequence
  Description of Artificial Sequence: Synthetic oligonucleotide
  Target: ATXN1; (+) strand; PAM type: NNGRRT; PAM sequence: GAGAAT
agtgggtttctaaaggttca

SEQ ID NO: 23776 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaaagcttggcaactgaaga

SEQ ID NO: 23777 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gtgggagaggaggcaaagag

SEQ ID NO: 23778 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gtgtgcaaaagttaactaag

SEQ ID NO: 23779 - DNA, 20 bp, Artificial Sequence
  Description of Artificial Sequence: Synthetic oligonucleotide
  Target: ATXN1; (+) strand; PAM type: NNGRRT; PAM sequence: CTGGGT
agttaactaaggtgagtttc

SEQ ID NO: 23780 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gattcataagcctggtgttg

SEQ ID NO: 23781 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gattcggaagcaggaggtac

SEQ ID NO: 23782 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gtgctgatggcaaacactca

SEQ ID NO: 23783 - DNA, 20 bp, Artificial Sequence
  Description of Artificial Sequence: Synthetic oligonucleotide
  Target: ATXN1; (+) strand; PAM type: NNGRRT; PAM sequence: ATGGAT
actttggaaggccaaggcag

SEQ ID NO: 23784 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctgaggcaa

SEQ ID NO: 23785 - DNA, 20 bp, Artificial Sequence
  Description of Artificial Sequence: Synthetic oligonucleotide
  Target: ATXN1; (+) strand; PAM type: NNGRRT; PAM sequence: GAGGAT
agaccagtcagtgaagtcct

SEQ ID NO: 23786 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aagactttgtaagtgacagc

SEQ ID NO: 23787 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cataaatggagaggaagata

SEQ ID NO: 23788 - DNA, 20 bp, Artificial Sequence
  Description of Artificial Sequence: Synthetic oligonucleotide
  Target: ATXN1; (+) strand; PAM type: NNGRRT; PAM sequence: GAGGGT
accaccagcaaacaggtaaa

SEQ ID NO: 23789 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gttcctatgttgattacagg

SEQ ID NO: 23790 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aggaaggatactgtcaccag

SEQ ID NO: 23791 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gcagaaagccagctgctaac

SEQ ID NO: 23792 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ctgaagctctgcttcagaaa

SEQ ID NO: 23793 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ttcaacgtaaaacaaagtgt

SEQ ID NO: 23794 - DNA, 20 bp, Artificial Sequence
  Description of Artificial Sequence: Synthetic oligonucleotide
  Target: ATXN1; (+) strand; PAM type: NNGRRT; PAM sequence: CAGGGT
aaacaaagtgtggggatcca

SEQ ID NO: 23795 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aagaagcctatctcacttat

SEQ ID NO: 23796 - DNA, 20 bp, Artificial Sequence
  Description of Artificial Sequence: Synthetic oligonucleotide
  Target: ATXN1; (+) strand; PAM type: NNGRRT; PAM sequence: CAGGAT
agcactttgagaggccaagg

SEQ ID NO: 23797 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggatgattgctggagccc

SEQ ID NO: 23798 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaaaattcagtgaagacttt

SEQ ID NO: 23799 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aagactttatgaatgacagc

SEQ ID NO: 23800 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttaaaattaaatacataaaa

SEQ ID NO: 23801 - DNA, 20 bp, Artificial Sequence
  Description of Artificial Sequence: Synthetic oligonucleotide
  Target: ATXN1; (+) strand; PAM type: NNGRRT; PAM sequence: GGGAAT
atttttttttaatgttgcaa

SEQ ID NO: 23802 - DNA, 20 bp, Artificial Sequence
  Description of Artificial Sequence: Synthetic oligonucleotide
  Target: ATXN1; (+) strand; PAM type: NNGRRT; PAM sequence: CCGGGT
aataaattatttactgcggg

SEQ ID NO: 23803 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggctgaggcag

SEQ ID NO: 23804 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcgggaggttgaggcag

SEQ ID NO: 23805 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tctgttgggcaagaactgaa

SEQ ID NO: 23806 - DNA, 20 bp, Artificial Sequence
  Description of Artificial Sequence: Synthetic oligonucleotide
  Target: ATXN1; (+) strand; PAM type: NNGRRT; PAM sequence: CTGAAT
attcattgcactagagggaa

SEQ ID NO: 23807 - DNA, 20 bp, Artificial Sequence
  Description of Artificial Sequence: Synthetic oligonucleotide
  Target: ATXN1; (+) strand; PAM type: NNGRRT; PAM sequence: CGGGGT
cttccaggtaatatcatgaa

SEQ ID NO: 23808 - DNA, 20 bp, Artificial Sequence
  Description of Artificial Sequence: Synthetic oligonucleotide
  Target: ATXN1; (+) strand; PAM type: NNGRRT; PAM sequence: TGGAAT
cattatgttggtgtatgctc

SEQ ID NO: 23809 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tttatcatttatttatagtt

SEQ ID NO: 23810 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttatttatagtttagagtgt

SEQ ID NO: 23811 - DNA, 20 bp, Artificial Sequence
  Description of Artificial Sequence: Synthetic oligonucleotide
  Target: ATXN1; (+) strand; PAM type: NNGRRT; PAM sequence: AGGGAT
gtcatgcatcatttaatgac

SEQ ID NO: 23812 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tttgtcactgtgcaacatca

SEQ ID NO: 23813 - DNA, 20 bp, Artificial Sequence
  Description of Artificial Sequence: Synthetic oligonucleotide
  Target: ATXN1; (+) strand; PAM type: NNGRRT; PAM sequence: CTGGAT
cacagagtactttcacaggc

SEQ ID NO: 23814 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ctggacggcatgctactgta

SEQ ID NO: 23815 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttttttttttttttttgaga

SEQ ID NO: 23816 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcgctctgtcgcccaggc

SEQ ID NO: 23817 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttttgtattcttagtagaga

SEQ ID NO: 23818 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cagggtttcaccgcgttagc

SEQ ID NO: 23819 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcggcctcccaaagtgc

SEQ ID NO: 23820 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gcaaaaaacttgccattaaa

SEQ ID NO: 23821 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ccttatgttttcagctaaaa

SEQ ID NO: 23822 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ctgtttgtgtgtttagttgt

SEQ ID NO: 23823 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ttttcaaatgtcctgttatt

SEQ ID NO: 23824 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gctaaaagatgtcaagtctt

SEQ ID NO: 23825 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aacaaaacaaaataccaagt

SEQ ID NO: 23826 - DNA, 20 bp, Artificial Sequence
  Description of Artificial Sequence: Synthetic oligonucleotide
  Target: ATXN1; (+) strand; PAM type: NNGRRT; PAM sequence: GTGGAT
aatgccacttcaagcagtta

SEQ ID NO: 23827 - DNA, 20 bp, Artificial Sequence
  Description of Artificial Sequence: Synthetic oligonucleotide
  Target: ATXN1; (+) strand; PAM type: NNGRRT; PAM sequence: CAGGAT
caaacaagcatgttaattat

SEQ ID NO: 23828 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gtgccctaaaatactggagg

SEQ ID NO: 23829 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aggtagcaggtcttgaaaat

SEQ ID NO: 23830 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaatcagaatgtacaccagt

SEQ ID NO: 23831 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aagtttaccgattgaaagat

SEQ ID NO: 23832 - DNA, 20 bp, Artificial Sequence
  Description of Artificial Sequence: Synthetic oligonucleotide
  Target: ATXN1; (+) strand; PAM type: NNGRRT; PAM sequence: GTGAAT
actcagactaatcaactgat

SEQ ID NO: 23833 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gccctataagtaggtaatgc

SEQ ID NO: 23834 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agcagtagttactttacaca

SEQ ID NO: 23835 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ctttacacactgaatatgaa

SEQ ID NO: 23836 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gctgactgtcatccagttcc

SEQ ID NO: 23837 - DNA, 20 bp, Artificial Sequence
  Description of Artificial Sequence: Synthetic oligonucleotide
  Target: ATXN1; (+) strand; PAM type: NNGRRT; PAM sequence: TTGGAT
cccacggtgatcatcaaaga

SEQ ID NO: 23838 - DNA, 20 bp, Artificial Sequence
  Description of Artificial Sequence: Synthetic oligonucleotide
  Target: ATXN1; (+) strand; PAM type: NNGRRT; PAM sequence: GAGGAT
agtgaccaagttgtaagaaa

SEQ ID NO: 23839 - DNA, 20 bp, Artificial Sequence
  Description of Artificial Sequence: Synthetic oligonucleotide
  Target: ATXN1; (+) strand; PAM type: NNGRRT; PAM sequence: GTGAAT
atgcctcagaagcttactgt

SEQ ID NO: 23840 - DNA, 20 bp, Artificial Sequence
  Description of Artificial Sequence: Synthetic oligonucleotide
  Target: ATXN1; (+) strand; PAM type: NNGRRT; PAM sequence: TGGAAT
cttctgtaactattacttta

SEQ ID NO: 23841 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cctttttttcgggacgtttg

SEQ ID NO: 23842 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ctccgttaatgtttaaacat

SEQ ID NO: 23843 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gcaaaagccttttttatttt

SEQ ID NO: 23844 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ctatcagtacccacagaaaa

SEQ ID NO: 23845 - DNA, 20 bp, Artificial Sequence
  Description of Artificial Sequence: Synthetic oligonucleotide
  Target: ATXN1; (+) strand; PAM type: NNGRRT; PAM sequence: AAGGAT
cccacagaaaatggggttgt

SEQ ID NO: 23846 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctttaccggcttggtaaaaa

SEQ ID NO: 23847 - DNA, 20 bp, Artificial Sequence
  Description of Artificial Sequence: Synthetic oligonucleotide
  Target: ATXN1; (+) strand; PAM type: NNGRRT; PAM sequence: GAGGAT
acagaatttggagagaggag

SEQ ID NO: 23848 - DNA, 20 bp, Artificial Sequence
  Description of Artificial Sequence: Synthetic oligonucleotide
  Target: ATXN1; (+) strand; PAM type: NNGRRT; PAM sequence: CTGGAT
aaagttaatatgtactttga

SEQ ID NO: 23849 - DNA, 20 bp, Artificial Sequence
  Description of Artificial Sequence: Synthetic oligonucleotide
  Target: ATXN1; (+) strand; PAM type: NNGRRT; PAM sequence: CTGGGT
atatgtactttgactggatt

SEQ ID NO: 23850 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ataagaaaataaattcattt

SEQ ID NO: 23851 - DNA, 20 bp, Artificial Sequence
  Description of Artificial Sequence: Synthetic oligonucleotide
  Target: ATXN1; (+) strand; PAM type: NNGRRT; PAM sequence: CAGAAT
caaaatcgatctgggagagg

SEQ ID NO: 23852 - DNA, 20 bp, Artificial Sequence
  Description of Artificial Sequence: Synthetic oligonucleotide
  Target: ATXN1; (+) strand; PAM type: NNGRRT; PAM sequence: AGGAGT
acttatatctgtagatgtga

SEQ ID NO: 23853 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aatcaacaaaacaaactggc

SEQ ID NO: 23854 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aaagttggctatattttaaa

SEQ ID NO: 23855 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ttaaaaaggatctcactcca

SEQ ID NO: 23856 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acagcagcagcagcaaagta

SEQ ID NO: 23857 - DNA, 20 bp, Artificial Sequence
  Description of Artificial Sequence: Synthetic oligonucleotide
  Target: ATXN1; (+) strand; PAM type: NNGRRT; PAM sequence: GGGAGT
caacctataaacagtgacct

SEQ ID NO: 23858 - DNA, 20 bp, Artificial Sequence
  Description of Artificial Sequence: Synthetic oligonucleotide
  Target: ATXN1; (+) strand; PAM type: NNGRRT; PAM sequence: TTGAAT
taatttgtttttacatgtat

SEQ ID NO: 23859 - DNA, 20 bp, Artificial Sequence
  Description of Artificial Sequence: Synthetic oligonucleotide
  Target: ATXN1; (+) strand; PAM type: NNGRRT; PAM sequence: TAGAAT
agagacaaacaggttctcag

SEQ ID NO: 23860 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttttttttttttttttgaga

SEQ ID NO: 23861 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttttgctctttcacccaggc

SEQ ID NO: 23862 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tcacccaggctggagtgcag

SEQ ID NO: 23863 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gcctcaggctcccaagtagc

SEQ ID NO: 23864 - DNA, 20 bp, Artificial Sequence
  Description of Artificial Sequence: Synthetic oligonucleotide
  Target: ATXN1; (+) strand; PAM type: NNGRRT; PAM sequence: CGGGAT
ttttgtatttttagtggaga

SEQ ID NO: 23865 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gctttgacctcccaaagtgc

SEQ ID NO: 23866 - DNA, 20 bp, Artificial Sequence
  Description of Artificial Sequence: Synthetic oligonucleotide
  Target: ATXN1; (+) strand; PAM type: NNGRRT; PAM sequence: AAGGGT
caccgcacctggcccaggaa

SEQ ID NO: 23867 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gctcatttggtctgattgtc

SEQ ID NO: 23868 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ttgtcaggaatagaccataa

SEQ ID NO: 23869 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ttactgttataagcagcctg

SEQ ID NO: 23870 - DNA, 20 bp, Artificial Sequence
  Description of Artificial Sequence: Synthetic oligonucleotide
  Target: ATXN1; (+) strand; PAM type: NNGRRT; PAM sequence: TGGAAT
cttccagtgatcccacctct

SEQ ID NO: 23871 - DNA, 20 bp, Artificial Sequence
  Description of Artificial Sequence: Synthetic oligonucleotide
  Target: ATXN1; (+) strand; PAM type: NNGRRT; PAM sequence: TTGAGT
catgcccttgtaaagccttc

SEQ ID NO: 23872 - DNA, 20 bp, Artificial Sequence
  Description of Artificial Sequence: Synthetic oligonucleotide
  Target: ATXN1; (+) strand; PAM type: NNGRRT; PAM sequence: CTGGAT
aaagccttcttgagtgtgga

SEQ ID NO: 23873 - DNA, 20 bp, Artificial Sequence
  Description of Artificial Sequence: Synthetic oligonucleotide
  Target: ATXN1; (+) strand; PAM type: NNGRRT; PAM sequence: CTGGGT
atgggagatcatttccaaga

SEQ ID NO: 23874 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gaagatggtggcttccatct

SEQ ID NO: 23875 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttgggatcttgcatcctctt

SEQ ID NO: 23876 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tgaggcctgctagcatctat

SEQ ID NO: 23877 - DNA, 20 bp, Artificial Sequence
  Description of Artificial Sequence: Synthetic oligonucleotide
  Target: ATXN1; (+) strand; PAM type: NNGRRT; PAM sequence: GTGGAT
gcctgctagcatctatgtga

SEQ ID NO: 23878 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tgttttaagccactaagatt

SEQ ID NO: 23879 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tgaaatttgactttccactg

SEQ ID NO: 23880 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tcttttttttttttttgaaa

SEQ ID NO: 23881 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tttgctcttgttgcccaggc

SEQ ID NO: 23882 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaagtagc

SEQ ID NO: 23883 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ttttgtatttttagtagaga

SEQ ID NO: 23884 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gtctcggcctcccaaagtgc

SEQ ID NO: 23885 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tttgcgtcatttaactatta

SEQ ID NO: 23886 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtaataaatagtcctataaa

SEQ ID NO: 23887 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aatgtctttttgcaattgta

SEQ ID NO: 23888 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtaaggaaaagaacaagata

SEQ ID NO: 23889 - DNA, 20 bp, Artificial Sequence
  Description of Artificial Sequence: Synthetic oligonucleotide
  Target: ATXN1; (+) strand; PAM type: NNGRRT; PAM sequence: TTGGAT
atagccacagtattttctgt

SEQ ID NO: 23890 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttttttttttttttttgaaa

SEQ ID NO: 23891 - DNA, 20 bp, Artificial Sequence
  Description of Artificial Sequence: Synthetic oligonucleotide
  Target: ATXN1; (+) strand; PAM type: NNGRRT; PAM sequence: CCGGGT
ctcgctgcaacctctgcctc

SEQ ID NO: 23892 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaagcagc

SEQ ID NO: 23893 - DNA, 20 bp, Artificial Sequence
  Description of Artificial Sequence: Synthetic oligonucleotide
  Target: ATXN1; (+) strand; PAM type: NNGRRT; PAM sequence: CGGGGT
taattaatctttagtagaga

SEQ ID NO: 23894 - DNA, 20 bp, Artificial Sequence
  Description of Artificial Sequence: Synthetic oligonucleotide
  Target: ATXN1; (+) strand; PAM type: NNGRRT; PAM sequence: TAGGAT
acctcggcctcccgaagtgc

SEQ ID NO: 23895 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gcaggagccaccgtgcccgg

SEQ ID NO: 23896 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gttggcaatagaaagtcact

SEQ ID NO: 23897 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aaattttttaaaaagaactt

SEQ ID NO: 23898 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ctcctgcctcaatacaaatt

SEQ ID NO: 23899 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gtgccgggaagaaactggtg

SEQ ID NO: 23900 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tttatttatttatttagaga

SEQ ID NO: 23901 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tcttgctctgtcacttaggc

SEQ ID NO: 23902 - DNA, 20 bp, Artificial Sequence
  Description of Artificial Sequence: Synthetic oligonucleotide
  Target: ATXN1; (+) strand; PAM type: NNGRRT; PAM sequence: TGGGAT
agctcagcctcccaagtagc

SEQ ID NO: 23903 - DNA, 20 bp, Artificial Sequence
  Description of Artificial Sequence: Synthetic oligonucleotide
  Target: ATXN1; (+) strand; PAM type: NNGRRT; PAM sequence: TGGAAT
atgtttttgatccatactga

SEQ ID NO: 23904 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ctttattttggtctgactct

SEQ ID NO: 23905 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaactaaagcactggaaaga

SEQ ID NO: 23906 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tgcaatttggacaattttgt

SEQ ID NO: 23907 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cagaagtagaaacagcttca

SEQ ID NO: 23908 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aagcaaaatggcataataca

SEQ ID NO: 23909 - DNA, 20 bp, Artificial Sequence
  Description of Artificial Sequence: Synthetic oligonucleotide
  Target: ATXN1; (+) strand; PAM type: NNGRRT; PAM sequence: AAGAGT
atggcataatacaatgaatg

SEQ ID NO: 23910 - DNA, 20 bp, Artificial Sequence
  Description of Artificial Sequence: Synthetic oligonucleotide
  Target: ATXN1; (+) strand; PAM type: NNGRRT; PAM sequence: GTGAAT
aaagtcaatcagattcgcaa

SEQ ID NO: 23911 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ggcctctctctaaataaagt

SEQ ID NO: 23912 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ataccagccggtacgttcca

SEQ ID NO: 23913 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tgttgtgccaaaattaaaag

SEQ ID NO: 23914 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aaaggaggataaaaaaaggt

SEQ ID NO: 23915 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gataatttgtttttaaaggt

SEQ ID NO: 23916 - DNA, 20 bp, Artificial Sequence
  Description of Artificial Sequence: Synthetic oligonucleotide
  Target: ATXN1; (+) strand; PAM type: NNGRRT; PAM sequence: GAGGGT
taaatttgggaaagactttg

SEQ ID NO: 23917 - DNA, 20 bp, Artificial Sequence
  Description of Artificial Sequence: Synthetic oligonucleotide
  Target: ATXN1; (+) strand; PAM type: NNGRRT; PAM sequence: CAGGGT
aaaggtgaaaccagtggaca

SEQ ID NO: 23918 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tcctcacacttaaaagctcc

SEQ ID NO: 23919 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ttgggtcctcaataaatttt

SEQ ID NO: 23920 - DNA, 20 bp, Artificial Sequence
  Description of Artificial Sequence: Synthetic oligonucleotide
  Target: ATXN1; (+) strand; PAM type: NNGRRT; PAM sequence: AAGAGT
agaacaaaaaagttagtgac

SEQ ID NO: 23921 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttaaattctcttctgtgcct

SEQ ID NO: 23922 - DNA, 20 bp, Artificial Sequence
  Description of Artificial Sequence: Synthetic oligonucleotide
  Target: ATXN1; (+) strand; PAM type: NNGRRT; PAM sequence: GTGGAT
ggccaatagtttcagcaatt

SEQ ID NO: 23923 - DNA, 20 bp, Artificial Sequence
  Description of Artificial Sequence: Synthetic oligonucleotide
  Target: ATXN1; (+) strand; PAM type: NNGRRT; PAM sequence: TGGAAT
cttaaaggggagcagcacca

SEQ ID NO: 23924 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tcattagtctatcttgaact

SEQ ID NO: 23925 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tagtctatcttgaactttgg

SEQ ID NO: 23926 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tggaaaattatattagttca

SEQ ID NO: 23927 - DNA, 20 bp, Artificial Sequence
  Description of Artificial Sequence: Synthetic oligonucleotide
  Target: ATXN1; (+) strand; PAM type: NNGRRT; PAM sequence: GAGAAT
actccgctgtacacatggaa

SEQ ID NO: 23928 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ctgtacacatggaagagaat

SEQ ID NO: 23929 - DNA, 20 bp, Artificial Sequence
  Description of Artificial Sequence: Synthetic oligonucleotide
  Target: ATXN1; (+) strand; PAM type: NNGRRT; PAM sequence: TGGAAT
cacatggaagagaatgggaa

SEQ ID NO: 23930 - DNA, 20 bp, Artificial Sequence
  Description of Artificial Sequence: Synthetic oligonucleotide
  Target: ATXN1; (+) strand; PAM type: NNGRRT; PAM sequence: TTGGGT
atgtccctccagaaaaggtc

SEQ ID NO: 23931 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ctccagaaaaggtcttgggt

SEQ ID NO: 23932 - DNA, 20 bp, Artificial Sequence
  Description of Artificial Sequence: Synthetic oligonucleotide
  Target: ATXN1; (+) strand; PAM type: NNGRRT; PAM sequence: GGGGGT
aaggtcttgggtgggggtgg

SEQ ID NO: 23933 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ttcccaccatttgtcctctt

SEQ ID NO: 23934 - DNA, 20 bp, Artificial Sequence
  Description of Artificial Sequence: Synthetic oligonucleotide
  Target: ATXN1; (+) strand; PAM type: NNGRRT; PAM sequence: CTGAGT
atttgtcctcttggggatca

SEQ ID NO: 23935 - DNA, 20 bp, Artificial Sequence
  Description of Artificial Sequence: Synthetic oligonucleotide
  Target: ATXN1; (+) strand; PAM type: NNGRRT; PAM sequence: AAGAGT
accatgagggcaccagaggg

SEQ ID NO: 23936 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gggcggaaaactgtatttac

SEQ ID NO: 23937 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tttaattttgttttattttt

SEQ ID NO: 23938 - DNA, 20 bp, Artificial Sequence
  Description of Artificial Sequence: Synthetic oligonucleotide
  Target: ATXN1; (+) strand; PAM type: NNGRRT; PAM sequence: TTGGGT
atgatcgttgtgcatattta

SEQ ID NO: 23939 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aatggtcaaatcaaggtatt

SEQ ID NO: 23940 - DNA, 20 bp, Artificial Sequence
  Description of Artificial Sequence: Synthetic oligonucleotide
  Target: ATXN1; (+) strand; PAM type: NNGRRT; PAM sequence: ATGAGT
atgtttcttagctccctcat

SEQ ID NO: 23941 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cttagctccctcatatgagt

SEQ ID NO: 23942 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agccatgttgttacaaatga

SEQ ID NO: 23943 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aatttcattcttttgtatgg

SEQ ID NO: 23944 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gattccatatcttggctata

SEQ ID NO: 23945 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tgaatagctgcaacaaacat

SEQ ID NO: 23946 - DNA, 20 bp, Artificial Sequence
  Description of Artificial Sequence: Synthetic oligonucleotide
  Target: ATXN1; (+) strand; PAM type: NNGRRT; PAM sequence: CTGGAT
atatactgatttcctttctt

SEQ ID NO: 23947 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tttctttctttctttttttt

SEQ ID NO: 23948 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gtctagctgtgtcaccaggc

SEQ ID NO: 23949 - DNA, 20 bp, Artificial Sequence
  Description of Artificial Sequence: Synthetic oligonucleotide
  Target: ATXN1; (+) strand; PAM type: NNGRRT; PAM sequence: CCGAGT
gattctcctgcctcagcctc

SEQ ID NO: 23950 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccgagtagc

SEQ ID NO: 23951 - DNA, 20 bp, Artificial Sequence
  Description of Artificial Sequence: Synthetic oligonucleotide
  Target: ATXN1; (+) strand; PAM type: NNGRRT; PAM sequence: CGGAGT
ttttgcatttatagtagaga

SEQ ID NO: 23952 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cggagtttcaccatgttggc

SEQ ID NO: 23953 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tttcttccaatctaggcttt

SEQ ID NO: 23954 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ttaaaatttcttttaactaa

SEQ ID NO: 23955 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ctaaacaacactggttatct

SEQ ID NO: 23956 - DNA, 20 bp, Artificial Sequence
  Description of Artificial Sequence: Synthetic oligonucleotide
  Target: ATXN1; (+) strand; PAM type: NNGRRT; PAM sequence: TTGAGT
aacattcacatgttaagccc

SEQ ID NO: 23957 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cactttcttgtttcaaagtg

SEQ ID NO: 23958 - DNA, 20 bp, Artificial Sequence
  Description of Artificial Sequence: Synthetic oligonucleotide
  Target: ATXN1; (+) strand; PAM type: NNGRRT; PAM sequence: ATGAAT
caaagtgaggagttggcttg

SEQ ID NO: 23959 - DNA, 20 bp, Artificial Sequence
  Description of Artificial Sequence: Synthetic oligonucleotide
  Target: ATXN1; (+) strand; PAM type: NNGRRT; PAM sequence: AGGAGT
accggttatcacatggaaaa

SEQ ID NO: 23960 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tctcactcacaagccacacg

SEQ ID NO: 23961 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tttgattcttagaaggacat

SEQ ID NO: 23962 - DNA, 20 bp, Artificial Sequence
  Description of Artificial Sequence: Synthetic oligonucleotide
  Target: ATXN1; (+) strand; PAM type: NNGRRT; PAM sequence: CCGAAT
caaggtatcctcagcccagc

SEQ ID NO: 23963 - DNA, 20 bp, Artificial Sequence
  Description of Artificial Sequence: Synthetic oligonucleotide
  Target: ATXN1; (+) strand; PAM type: NNGRRT; PAM sequence: TTGGGT
tttctaaacgcttaactccc

SEQ ID NO: 23964 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tgtaatgttgcctcatttgt

SEQ ID NO: 23965 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ttgctctcatttttctctaa

SEQ ID NO: 23966 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tgtttttattactaaagttt

SEQ ID NO: 23967 - DNA, 20 bp, Artificial Sequence
  Description of Artificial Sequence: Synthetic oligonucleotide
  Target: ATXN1; (+) strand; PAM type: NNGRRT; PAM sequence: GAGAGT
acatcttgccttttggtctt

SEQ ID NO: 23968 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tagatattattaaagagaac

SEQ ID NO: 23969 - DNA, 20 bp, Artificial Sequence
  Description of Artificial Sequence: Synthetic oligonucleotide
  Target: ATXN1; (+) strand; PAM type: NNGRRT; PAM sequence: TAGAGT
ttaaagagaacaggagtcta

SEQ ID NO: 23970 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ggagtctatagagttcagcc

SEQ ID NO: 23971 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tttgtgactttctcagggaa

SEQ ID NO: 23972 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tgtcctactgcaaactgaaa

SEQ ID NO: 23973 - DNA, 20 bp, Artificial Sequence
  Description of Artificial Sequence: Synthetic oligonucleotide
  Target: ATXN1; (+) strand; PAM type: NNGRRT; PAM sequence: TAGGAT
caaactgaaatagaataaag

SEQ ID NO: 23974 - DNA, 20 bp, Artificial Sequence
  Description of Artificial Sequence: Synthetic oligonucleotide
  Target: ATXN1; (+) strand; PAM type: NNGRRT; PAM sequence: AGGAAT
cgtatacctctgttttcagt

SEQ ID NO: 23975 - DNA, 20 bp, Artificial Sequence
  Description of Artificial Sequence: Synthetic oligonucleotide
  Target: ATXN1; (+) strand; PAM type: NNGRRT; PAM sequence: AGGGGT
actttattttattttgagat

SEQ ID NO: 23976 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aatcctcccaccttggcctc

SEQ ID NO: 23977 - DNA, 20 bp, Artificial Sequence
  Description of Artificial Sequence: Synthetic oligonucleotide
  Target: ATXN1; (+) strand; PAM type: NNGRRT; PAM sequence: AAGGAT
cccaccttggcctcctgggt

SEQ ID NO: 23978 - DNA, 20 bp, Artificial Sequence
  Description of Artificial Sequence: Synthetic oligonucleotide
  Target: ATXN1; (+) strand; PAM type: NNGRRT; PAM sequence: ATGAAT
cctgggtaaggatctttgta

SEQ ID NO: 23979 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tttgtaatgaatattattat

SEQ ID NO: 23980 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atgacagactgcaggaagcc

SEQ ID NO: 23981 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctgtgcagaagttaagaaag

SEQ ID NO: 23982 - DNA, 20 bp, Artificial Sequence
  Description of Artificial Sequence: Synthetic oligonucleotide
  Target: ATXN1; (+) strand; PAM type: NNGRRT; PAM sequence: TTGAAT
actgtgatagactttctgcc

SEQ ID NO: 23983 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ccatttgtaagctccattta

SEQ ID NO: 23984 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctactacaaaaggcagtttt

SEQ ID NO: 23985 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atcactgctattaatcagta

SEQ ID NO: 23986 - DNA, 20 bp, Artificial Sequence
  Description of Artificial Sequence: Synthetic oligonucleotide
  Target: ATXN1; (+) strand; PAM type: NNGRRT; PAM sequence: GTGAAT
agaattgatgtccctatttg

SEQ ID NO: 23987 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tatattaaatttgtcagttc

SEQ ID NO: 23988 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cccatgacccccaaccaaga

SEQ ID NO: 23989 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gtaagccaacacagagaagc

SEQ ID NO: 23990 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gtgggcgctcagagagactc

SEQ ID NO: 23991 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tcctgggtctggtcacttct

SEQ ID NO: 23992 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gtggcccaacttagaaatac

SEQ ID NO: 23993 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ctatttcctggttatgctac

SEQ ID NO: 23994 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tggttctccaatcacctctc

SEQ ID NO: 23995 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aactatcactaaagaggaag

SEQ ID NO: 23996 - DNA, 20 bp, Artificial Sequence
  Description of Artificial Sequence: Synthetic oligonucleotide
  Target: ATXN1; (+) strand; PAM type: NNGRRT; PAM sequence: GAGGAT
atctggagaaaacagatgtg

SEQ ID NO: 23997 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ttacttggctcatctatatt

SEQ ID NO: 23998 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ctaaagaaaataaaatgatt

SEQ ID NO: 23999 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tcactgtaaactgacaagat

SEQ ID NO: 24000 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taaactgacaagatatgaat

SEQ ID NO: 24001 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cattagcataaaaaagctta

SEQ ID NO: 24002 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tcagttcaccaacaggctta

SEQ ID NO: 24003 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tgtaataagaagtatctgct

SEQ ID NO: 24004 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttttttttgcagtaacgtaa

SEQ ID NO: 24005 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aggaaccattttatgcagga

SEQ ID NO: 24006 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gcctcaggagctaggcagat

SEQ ID NO: 24007 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tctaagcttccaaacaaaca

SEQ ID NO: 24008 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aatgattaaaaagggactca

SEQ ID NO: 24009 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cagagtctattaacattccc

SEQ ID NO: 24010 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aggcatatttatatcaacac

SEQ ID NO: 24011 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cagtcttaattcgaacaatc

SEQ ID NO: 24012 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ggtcaaaatcattatatatt

SEQ ID NO: 24013 - DNA, 20 bp, Artificial Sequence
  Description of Artificial Sequence: Synthetic oligonucleotide
  Target: ATXN1; (+) strand; PAM type: NNGRRT; PAM sequence: ACGAAT
aatcattatatattttgaat

SEQ ID NO: 24014 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tattttgaatacgaatatgg

SEQ ID NO: 24015 - DNA, 20 bp, Artificial Sequence
  Description of Artificial Sequence: Synthetic oligonucleotide
  Target: ATXN1; (+) strand; PAM type: NNGRRT; PAM sequence: AAGGAT
cgaatatggttgaatatgac

SEQ ID NO: 24016 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tggttgaatatgacaaggat

SEQ ID NO: 24017 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tgacatgtaactgaaatgac

SEQ ID NO: 24018 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ctttgttttaaaataggtat

SEQ ID NO: 24019 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ccaaggaccttttatgttaa

SEQ ID NO: 24020 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ttatgttaaatgaatcacag

SEQ ID NO: 24021 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tttaacatactttaaggccc

SEQ ID NO: 24022 - DNA, 20 bp, Artificial Sequence
  Description of Artificial Sequence: Synthetic oligonucleotide
  Target: ATXN1; (+) strand; PAM type: NNGRRT; PAM sequence: CTGAAT
atactttaaggcccaggaat

SEQ ID NO: 24023 - DNA, 20 bp, Artificial Sequence
  Description of Artificial Sequence: Synthetic oligonucleotide
  Target: ATXN1; (+) strand; PAM type: NNGRRT; PAM sequence: TAGAGT
aagtcctagggcctctggtc

SEQ ID NO: 24024 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tgtggctctagtaaatgcct

SEQ ID NO: 24025 - DNA, 20 bp, Artificial Sequence
  Description of Artificial Sequence: Synthetic oligonucleotide
  Target: ATXN1; (+) strand; PAM type: NNGRRT; PAM sequence: CAGAAT
catacccacgtcctaatccc

SEQ ID NO: 24026 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ctaatccccagaatcagtct

SEQ ID NO: 24027 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ttcacagatgtgatgacatt

SEQ ID NO: 24028 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gagatggggagatgatacag

SEQ ID NO: 24029 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cagcactctgggaggccgag

SEQ ID NO: 24030 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actctgggaggccgaggcgg

SEQ ID NO: 24031 - DNA, 20 bp, Artificial Sequence
  Description of Artificial Sequence: Synthetic oligonucleotide
  Target: ATXN1; (+) strand; PAM type: NNGRRT; PAM sequence: GAGAGT
cgggtggatcgcctgaggtc

SEQ ID NO: 24032 - DNA, 20 bp, Artificial Sequence
  Description of Artificial Sequence: Synthetic oligonucleotide
  Target: ATXN1; (+) strand; PAM type: NNGRRT; PAM sequence: TTGGGT
agtaaaaatataaaatttag

SEQ ID NO: 24033 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggaggctgaggcag

SEQ ID NO: 24034 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctgcactccagcctgggcga

SEQ ID NO: 24035 - DNA, 20 bp, Artificial Sequence
  Description of Artificial Sequence: Synthetic oligonucleotide
  Target: ATXN1; (+) strand; PAM type: NNGRRT; PAM sequence: AAGGAT
agaaagaaaacggaaaaggc

SEQ ID NO: 24036 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaaacggaaaaggcaaggat

SEQ ID NO: 24037 - DNA, 20 bp, Artificial Sequence
  Description of Artificial Sequence: Synthetic oligonucleotide
  Target: ATXN1; (+) strand; PAM type: NNGRRT; PAM sequence: TAGAGT
caaggatatgaattattctc

SEQ ID NO: 24038 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tattctctagagtccctaca

SEQ ID NO: 24039 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tcagcctggtgagacctgta

SEQ ID NO: 24040 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctttaccaaacacataaaga

SEQ ID NO: 24041 - DNA, 20 bp, Artificial Sequence
  Description of Artificial Sequence: Synthetic oligonucleotide
  Target: ATXN1; (+) strand; PAM type: NNGRRT; PAM sequence: TGGGAT
aaatattaatttggcacaaa

SEQ ID NO: 24042 - DNA, 20 bp, Artificial Sequence
  Description of Artificial Sequence: Synthetic oligonucleotide
  Target: ATXN1; (+) strand; PAM type: NNGRRT; PAM sequence: CCGGGT
tggcacaaatgggatatggc

SEQ ID NO: 24043 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cttggaaactatgagaagga

SEQ ID NO: 24044 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gagaaggaaagggtctaagg

SEQ ID NO: 24045 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gaggactgtttggtgcattg

SEQ ID NO: 24046 - DNA, 20 bp, Artificial Sequence
  Description of Artificial Sequence: Synthetic oligonucleotide
  Target: ATXN1; (+) strand; PAM type: NNGRRT; PAM sequence: TGGAGT
cctgactctgctgcccaggc

SEQ ID NO: 24047 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcgacctcctaaagtgc

SEQ ID NO: 24048 - DNA, 20 bp, Artificial Sequence
  Description of Artificial Sequence: Synthetic oligonucleotide
  Target: ATXN1; (+) strand; PAM type: NNGRRT; PAM sequence: CAGGAT
caatgcccccagccccattg

SEQ ID NO: 24049 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ttgctgctggtctcattcaa

SEQ ID NO: 24050 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ctcattcaaatgagtctccc

SEQ ID NO: 24051 - DNA, 20 bp, Artificial Sequence
  Description of Artificial Sequence: Synthetic oligonucleotide
  Target: ATXN1; (+) strand; PAM type: NNGRRT; PAM sequence: CAGAAT
attttaaaacagctcaaact

SEQ ID NO: 24052 - DNA, 20 bp, Artificial Sequence
  Description of Artificial Sequence: Synthetic oligonucleotide
  Target: ATXN1; (+) strand; PAM type: NNGRRT; PAM sequence: CGGAGT
ttttttttttttttttgaga

SEQ ID NO: 24053 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gtctcgctctgttgccaggc

SEQ ID NO: 24054 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aacactgcaagctccgcctc

SEQ ID NO: 24055 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaagtagc

SEQ ID NO: 24056 - DNA, 20 bp, Artificial Sequence
  Description of Artificial Sequence: Synthetic oligonucleotide
  Target: ATXN1; (+) strand; PAM type: NNGRRT; PAM sequence: CGGGGT
ttttgtatttttagtagaga

SEQ ID NO: 24057 - DNA, 20 bp, Artificial Sequence
  Description of Artificial Sequence: Synthetic oligonucleotide
  Target: ATXN1; (+) strand; PAM type: NNGRRT; PAM sequence: TGGGAT
accttggcctccgaaaatgc

SEQ ID NO: 24058 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgatggcaaaacagatggtt

SEQ ID NO: 24059 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ctgggaaatggccactgtac

SEQ ID NO: 24060 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agatcctgttttgtgtagtt

SEQ ID NO: 24061 - DNA, 20 bp, Artificial Sequence
  Description of Artificial Sequence: Synthetic oligonucleotide
  Target: ATXN1; (+) strand; PAM type: NNGRRT; PAM sequence: TTGGAT
acagactgcagcttccaagg

SEQ ID NO: 24062 - DNA, 20 bp, Artificial Sequence
  Description of Artificial Sequence: Synthetic oligonucleotide
  Target: ATXN1; (+) strand; PAM type: NNGRRT; PAM sequence: GTGGGT
tctctgaagtctagggggag

SEQ ID NO: 24063 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gttgtagattggtgacttta

SEQ ID NO: 24064 - DNA, 20 bp, Artificial Sequence
  Description of Artificial Sequence: Synthetic oligonucleotide
  Target: ATXN1; (+) strand; PAM type: NNGRRT; PAM sequence: AGGAAT
actttatagaatgtgcttcc

SEQ ID NO: 24065 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ccgcaatcaaatactgccgt

SEQ ID NO: 24066 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tctgaaaatatcacatgact

SEQ ID NO: 24067 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aggatctaagagccaaggtc

SEQ ID NO: 24068 - DNA, 20 bp, Artificial Sequence
  Description of Artificial Sequence: Synthetic oligonucleotide
  Target: ATXN1; (+) strand; PAM type: NNGRRT; PAM sequence: GGGAAT
atcacacaacatactcatta

SEQ ID NO: 24069 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gatattttaaaattaaaacg

SEQ ID NO: 24070 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaattaaaacgaagggtgga

SEQ ID NO: 24071 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggctgaggctg

SEQ ID NO: 24072 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ctggcggatcatttgaggtc

SEQ ID NO: 24073 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gactcgggaggctgaggcag

SEQ ID NO: 24074 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttgcaccactgcactccagc

SEQ ID NO: 24075 - DNA, 20 bp, Artificial Sequence
  Description of Artificial Sequence: Synthetic oligonucleotide
  Target: ATXN1; (+) strand; PAM type: NNGRRT; PAM sequence: CGGAGT
ctgcactccagcctgggtga

SEQ ID NO: 24076 - DNA, 20 bp, Artificial Sequence
  Description of Artificial Sequence: Synthetic oligonucleotide
  Target: ATXN1; (+) strand; PAM type: NNGRRT; PAM sequence: CAGGGT
actgccaaaggagaagcgga

SEQ ID NO: 24077 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gcattcccaaatgctgcatt

SEQ ID NO: 24078 - DNA, 20 bp, Artificial Sequence
  Description of Artificial Sequence: Synthetic oligonucleotide
  Target: ATXN1; (+) strand; PAM type: NNGRRT; PAM sequence: CAGGGT
aggctactaatgctcatcaa

SEQ ID NO: 24079 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gtagtattacattggtaagt

SEQ ID NO: 24080 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tattacattggtaagtgtga

SEQ ID NO: 24081 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tggctagtcaagaagagcaa

SEQ ID NO: 24082 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aacatcttacttcttcatta

SEQ ID NO: 24083 - DNA, 20 bp, Artificial Sequence
  Description of Artificial Sequence: Synthetic oligonucleotide
  Target: ATXN1; (+) strand; PAM type: NNGRRT; PAM sequence: GAGGAT
cctactttgtgctaggccct

SEQ ID NO: 24084 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gctaggccctgaggatacac

SEQ ID NO: 24085 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ggaaaataaacaaacaatgg

SEQ ID NO: 24086 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ttatgaaagaggaaagcagt

SEQ ID NO: 24087 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gaggaaagcagtctgagtgg

SEQ ID NO: 24088 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aaagcagtctgagtggtgga

SEQ ID NO: 24089 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tggattcttcttcctataaa

SEQ ID NO: 24090 - DNA, 20 bp, Artificial Sequence
  Description of Artificial Sequence: Synthetic oligonucleotide
  Target: ATXN1; (+) strand; PAM type: NNGRRT; PAM sequence: TTGGGT
cctataaaaagaatataaaa

SEQ ID NO: 24091 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tacaaaactgacctctactc

SEQ ID NO: 24092 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ttctattccatcacaagatt

SEQ ID NO: 24093 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttaacactttttttaaaaca

SEQ ID NO: 24094 - DNA, 20 bp, Artificial Sequence
  Description of Artificial Sequence: Synthetic oligonucleotide
  Target: ATXN1; (+) strand; PAM type: NNGRRT; PAM sequence: ATGAAT
cactttttttaaaacaatga

SEQ ID NO: 24095 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tgtccttaaagatttccaac

SEQ ID NO: 24096 - DNA, 20 bp, Artificial Sequence
  Description of Artificial Sequence: Synthetic oligonucleotide
  Target: ATXN1; (+) strand; PAM type: NNGRRT; PAM sequence: GTGAAT
atgtaaacaaacaatacggt

SEQ ID NO: 24097 - DNA, 20 bp, Artificial Sequence
  Description of Artificial Sequence: Synthetic oligonucleotide
  Target: ATXN1; (+) strand; PAM type: NNGRRT; PAM sequence: GGGAAT
acaatacggtgtgaatcaag

SEQ ID NO: 24098 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cggtgtgaatcaaggggaat

SEQ ID NO: 24099 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ttacgtgtgctctgggagag

SEQ ID NO: 24100 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tattttttgattcccctccc

SEQ ID NO: 24101 - DNA, 20 bp, Artificial Sequence
  Description of Artificial Sequence: Synthetic oligonucleotide
  Target: ATXN1; (+) strand; PAM type: NNGRRT; PAM sequence: TTGAAT
atttttcaggccattgctta

SEQ ID NO: 24102 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgtgtcctcatcattaggtc

SEQ ID NO: 24103 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tccacaaagagcaaaaagat

SEQ ID NO: 24104 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gggatacaaaacttgtatag

SEQ ID NO: 24105 - DNA, 20 bp, Artificial Sequence
  Description of Artificial Sequence: Synthetic oligonucleotide
  Target: ATXN1; (+) strand; PAM type: NNGRRT; PAM sequence: CGGGAT
atgttcacctatgtctttca

SEQ ID NO: 24106 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ctttcacgggatgactaatt

SEQ ID NO: 24107 - DNA, 20 bp, Artificial Sequence
  Description of Artificial Sequence: Synthetic oligonucleotide
  Target: ATXN1; (+) strand; PAM type: NNGRRT; PAM sequence: TCGAAT
ctgaaaagtgtttggtgcac

SEQ ID NO: 24108 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gccaatgtttaagttacttt

SEQ ID NO: 24109 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ttttttcataatctgacttc

SEQ ID NO: 24110 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gaacctggctgtcttttggc

SEQ ID NO: 24111 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gagaaatcagagacagaaag

SEQ ID NO: 24112 - DNA, 20 bp, Artificial Sequence
  Description of Artificial Sequence: Synthetic oligonucleotide
  Target: ATXN1; (+) strand; PAM type: NNGRRT; PAM sequence: TAGGAT
cagaaagctgagtaggaaca

SEQ ID NO: 24113 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ctgagtaggaacataggatg

SEQ ID NO: 24114 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ggaattaagattgaccttta

SEQ ID NO: 24115 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttttatcattcctaagagat

SEQ ID NO: 24116 - DNA, 20 bp, Artificial Sequence
  Description of Artificial Sequence: Synthetic oligonucleotide
  Target: ATXN1; (+) strand; PAM type: NNGRRT; PAM sequence: AGGAGT
gcagggaaagagaaaaagaa

SEQ ID NO: 24117 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aaaagaaaggagtgaagggg

SEQ ID NO: 24118 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cagcactttgggaggccgag

SEQ ID NO: 24119 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccgaggcgg

SEQ ID NO: 24120 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggtggatcacctgaggtc

SEQ ID NO: 24121 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tacttgggaggctgaggcag

SEQ ID NO: 24122 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgcaccccagcctgggcaac

SEQ ID NO: 24123 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tctcaaaaaaaaaaaaagaa

SEQ ID NO: 24124 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aaggagtgatggaagaaaag

SEQ ID NO: 24125 - DNA, 20 bp, Artificial Sequence
  Description of Artificial Sequence: Synthetic oligonucleotide
  Target: ATXN1; (+) strand; PAM type: NNGRRT; PAM sequence: ATGGAT
agtgatggaagaaaagatgg

SEQ ID NO: 24126 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggaagaaaagatggatgg

SEQ ID NO: 24127 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aagaaaagatggatggatgg

SEQ ID NO: 24128 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggatggatgaatag

SEQ ID NO: 24129 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggatgaatagatgg

SEQ ID NO: 24130 - DNA, 20 bp, Artificial Sequence
  Description of Artificial Sequence: Synthetic oligonucleotide
  Target: ATXN1; (+) strand; PAM type: NNGRRT; PAM sequence: GAGGGT
atagatggatggataggtgg

SEQ ID NO: 24131 - DNA, 20 bp, Artificial Sequence
  Description of Artificial Sequence: Synthetic oligonucleotide
  Target: ATXN1; (+) strand; PAM type: NNGRRT; PAM sequence: GTGGAT
atggatggataggtgggagg

SEQ ID NO: 24132 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggataggtgggagggtgg

SEQ ID NO: 24133 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggacaaatagatag

SEQ ID NO: 24134 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atggacaaatagatagatgg

SEQ ID NO: 24135 - DNA, 20 bp, Artificial Sequence
  Description of Artificial Sequence: Synthetic oligonucleotide
  Target: ATXN1; (+) strand; PAM type: NNGRRT; PAM sequence: ATGGAT
acaaatagatagatggatga

SEQ ID NO: 24136 - DNA, 20 bp, Artificial Sequence
  Description of Artificial Sequence: Synthetic oligonucleotide
  Target: ATXN1; (+) strand; PAM type: NNGRRT; PAM sequence: ATGGGT
atagatagatggatgaatgg

SEQ ID NO: 24137 - DNA, 20 bp, Artificial Sequence
  Description of Artificial Sequence: Synthetic oligonucleotide
  Target: ATXN1; (+) strand; PAM type: NNGRRT; PAM sequence: GTGGAT
atagatggatgaatggatgg

SEQ ID NO: 24138 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatgaatggatgggtgg

SEQ ID NO: 24139 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atgaatggatgggtggatgg

SEQ ID NO: 24140 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atgggtggatggatgaatag

SEQ ID NO: 24141 - DNA, 20 bp, Artificial Sequence
  Description of Artificial Sequence: Synthetic oligonucleotide
  Target: ATXN1; (+) strand; PAM type: NNGRRT; PAM sequence: AAGGAT
atggatgaatagatggatgg

SEQ ID NO: 24142 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atagatggatggaaggatag

SEQ ID NO: 24143 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggaaggatagatga

SEQ ID NO: 24144 - DNA, 20 bp, Artificial Sequence
  Description of Artificial Sequence: Synthetic oligonucleotide
  Target: ATXN1; (+) strand; PAM type: NNGRRT; PAM sequence: ATGGGT
atggaaggatagatgaatgg

SEQ ID NO: 24145 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aaggatagatgaatggatgg

SEQ ID NO: 24146 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atagatgaatggatgggtgg

SEQ ID NO: 24147 - DNA, 20 bp, Artificial Sequence
  Description of Artificial Sequence: Synthetic oligonucleotide
  Target: ATXN1; (+) strand; PAM type: NNGRRT; PAM sequence: ACGGAT
atggatgggtgggtgggtgg

SEQ ID NO: 24148 - DNA, 20 bp, Artificial Sequence
  Description of Artificial Sequence: Synthetic oligonucleotide
  Target: ATXN1; (+) strand; PAM type: NNGRRT; PAM sequence: ATGGGT
atgggtgggtgggtggacgg

SEQ ID NO: 24149 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gtgggtggacggatgggtgg

SEQ ID NO: 24150 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gtggacggatgggtggaagg

SEQ ID NO: 24151 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atgggtggaaggatgaatag

SEQ ID NO: 24152 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gtggaaggatgaatagatgg

SEQ ID NO: 24153 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aaggatgaatagatggatgg

SEQ ID NO: 24154 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atgaatagatggatggatgg

SEQ ID NO: 24155 - DNA, 20 bp, Artificial Sequence
  Description of Artificial Sequence: Synthetic oligonucleotide
  Target: ATXN1; (+) strand; PAM type: NNGRRT; PAM sequence: GTGGAT
atagatggatggatgggtgg

SEQ ID NO: 24156 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggatgggtgggtgg

SEQ ID NO: 24157 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatgggtgggtggatgg

SEQ ID NO: 24158 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atgggtgggtggatggatgg

SEQ ID NO: 24159 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gtgggtggatggatggatgg

SEQ ID NO: 24160 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atggatggatggatgagtta

SEQ ID NO: 24161 - DNA, 20 bp, Artificial Sequence
  Description of Artificial Sequence: Synthetic oligonucleotide
  Target: ATXN1; (+) strand; PAM type: NNGRRT; PAM sequence: GTGGAT
atggatggatgagttagtgg

SEQ ID NO: 24162 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatgagttagtgggtgg

SEQ ID NO: 24163 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atgagttagtgggtggatgg

SEQ ID NO: 24164 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gttagtgggtggatggatgg

SEQ ID NO: 24165 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gtgggtggatggatggatgg

SEQ ID NO: 24166 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gtggatggatggatggatgg

SEQ ID NO: 24167 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggatggatggatgg

SEQ ID NO: 24168 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggatggatggatgg

SEQ ID NO: 24169 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggatggatggatgg

SEQ ID NO: 24170 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggatggatggatgg

SEQ ID NO: 24171 - DNA, 20 bp, Artificial Sequence
  Description of Artificial Sequence: Synthetic oligonucleotide
  Target: ATXN1; (+) strand; PAM type: NNGRRT; PAM sequence: ATGGGT
atggatggatggatggatat

SEQ ID NO: 24172 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atggatggatggatatatgg

SEQ ID NO: 24173 - DNA, 20 bp, Artificial Sequence
  Description of Artificial Sequence: Synthetic oligonucleotide
  Target: ATXN1; (+) strand; PAM type: NNGRRT; PAM sequence: GTGGAT
atggatggatatatgggtgg

SEQ ID NO: 24174 - DNA, 20 bp, Artificial Sequence
  Description of Artificial Sequence: Synthetic oligonucleotide
  Target: ATXN1; (+) strand; PAM type: NNGRRT; PAM sequence: GTGGAT
atatatgggtgggtggatag

SEQ ID NO: 24175 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gtgggtggataggtggatgg

SEQ ID NO: 24176 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gtggatgggaggatagatag

SEQ ID NO: 24177 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gaggatagatagatggatag

SEQ ID NO: 24178 - DNA, 20 bp, Artificial Sequence
  Description of Artificial Sequence: Synthetic oligonucleotide
  Target: ATXN1; (+) strand; PAM type: NNGRRT; PAM sequence: GTGGGT
atagatagatggataggtgg

SEQ ID NO: 24179 - DNA, 20 bp, Artificial Sequence
  Description of Artificial Sequence: Synthetic oligonucleotide
  Target: ATXN1; (+) strand; PAM type: NNGRRT; PAM sequence: GTGGAT
atagatggataggtgggtgg

SEQ ID NO: 24180 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggataggtgggtgggtgg

SEQ ID NO: 24181 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ataggtgggtgggtggatgg

SEQ ID NO: 24182 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gtgggtgggtggatggatgg

SEQ ID NO: 24183 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gtgggtggatggatggatgg

SEQ ID NO: 24184 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gtggatggatggatggatgg

SEQ ID NO: 24185 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggatggatggatgg

SEQ ID NO: 24186 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggatggatggatgg

SEQ ID NO: 24187 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggatggatggatggatgg

SEQ ID NO: 24188 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atggatggatggatggatgg

SEQ ID NO: 24189 - DNA, 20 bp, Artificial Sequence
  Description of Artificial Sequence: Synthetic oligonucleotide
  Target: ATXN1; (+) strand; PAM type: NNGRRT; PAM sequence: TGGAGT
caaagagaagggaaatatag

SEQ ID NO: 24190 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gagaagggaaatatagtgga

SEQ ID NO: 24191 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ttcccacaagacactccaca

SEQ ID NO: 24192 - DNA, 20 bp, Artificial Sequence
  Description of Artificial Sequence: Synthetic oligonucleotide
  Target: ATXN1; (+) strand; PAM type: NNGRRT; PAM sequence: TTGGGT
acactgaagtgtgataacta

SEQ ID NO: 24193 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gtatcactacagttaaacgg

SEQ ID NO: 24194 - DNA, 20 bp, Artificial Sequence
  Description of Artificial Sequence: Synthetic oligonucleotide
  Target: ATXN1; (+) strand; PAM type: NNGRRT; PAM sequence: ATGAAT
agtaagcttctttaacttta

SEQ ID NO: 24195 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tgttaaagttaaaggaactg

SEQ ID NO: 24196 - DNA, 20 bp, Artificial Sequence
  Description of Artificial Sequence: Synthetic oligonucleotide
  Target: ATXN1; (+) strand; PAM type: NNGRRT; PAM sequence: TTGAGT
aggaactgtaggatctccta

SEQ ID NO: 24197 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gttcataatgtggtaatatt

SEQ ID NO: 24198 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atacagataataaattctat

SEQ ID NO: 24199 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttgtttttttctggtgggag

SEQ ID NO: 24200 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gagcagaattggcctgtgta

SEQ ID NO: 24201 - DNA, 20 bp, Artificial Sequence
  Description of Artificial Sequence: Synthetic oligonucleotide
  Target: ATXN1; (+) strand; PAM type: NNGRRT; PAM sequence: AGGGGT
attggcctgtgtagagggtc

SEQ ID NO: 24202 - DNA, 20 bp, Artificial Sequence
  Description of Artificial Sequence: Synthetic oligonucleotide
  Target: ATXN1; (+) strand; PAM type: NNGRRT; PAM sequence: CTGAGT
cttctctaatctacagtgtg

SEQ ID NO: 24203 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tgaaacatacattcctccgg

SEQ ID NO: 24204 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ggcagctctgacactggggc

SEQ ID NO: 24205 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aaatgaaacaaatacaagta

SEQ ID NO: 24206 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ccacccttcattatttcttt

SEQ ID NO: 24207 - DNA, 20 bp, Artificial Sequence
  Description of Artificial Sequence: Synthetic oligonucleotide
  Target: ATXN1; (+) strand; PAM type: NNGRRT; PAM sequence: TGGAAT
attatttctttgagaatggt

SEQ ID NO: 24208 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gagaggttagcctctatcga

SEQ ID NO: 24209 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aaaccagtgattgagctaaa

SEQ ID NO: 24210 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtgtgtggtcaacaggtgag

SEQ ID NO: 24211 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gtcaacaggtgagaggaatg

SEQ ID NO: 24212 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gacagtgctccagtagaccc

SEQ ID NO: 24213 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gccactgaggacaagggaac

SEQ ID NO: 24214 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ccacacttaagcctgcagtg

SEQ ID NO: 24215 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caagtgtaacacgaacatta

SEQ ID NO: 24216 - DNA, 20 bp, Artificial Sequence
  Description of Artificial Sequence: Synthetic oligonucleotide
  Target: ATXN1; (+) strand; PAM type: NNGRRT; PAM sequence: AAGGAT
cctgcctcatgcatatgaaa

SEQ ID NO: 24217 - DNA, 20 bp, Artificial Sequence
  Description of Artificial Sequence: Synthetic oligonucleotide
  Target: ATXN1; (+) strand; PAM type: NNGRRT; PAM sequence: TGGGAT
catcaatgagcaataatgca

SEQ ID NO: 24218 - DNA, 20 bp, Artificial Sequence
  Description of Artificial Sequence: Synthetic oligonucleotide
  Target: ATXN1; (+) strand; PAM type: NNGRRT; PAM sequence: GGGAAT
caataatgcatgggatttgt

SEQ ID NO: 24219 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tcccattagctcacccttgt

SEQ ID NO: 24220 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tgtctggatgaaagagctca

SEQ ID NO: 24221 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gagcatattgcacagtaaac

SEQ ID NO: 24222 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aagtaccaatatttgctctt

SEQ ID NO: 24223 - DNA, 20 bp, Artificial Sequence
  Description of Artificial Sequence: Synthetic oligonucleotide
  Target: ATXN1; (+) strand; PAM type: NNGRRT; PAM sequence: GCGAAT
aaagtccccctgaaccagaa

SEQ ID NO: 24224 - DNA, 20 bp, Artificial Sequence
  Description of Artificial Sequence: Synthetic oligonucleotide
  Target: ATXN1; (+) strand; PAM type: NNGRRT; PAM sequence: CCGAAT
ggttagccgctgttctcctt

SEQ ID NO: 24225 - DNA, 20 bp, Artificial Sequence
  Description of Artificial Sequence: Synthetic oligonucleotide
  Target: ATXN1; (+) strand; PAM type: NNGRRT; PAM sequence: TTGGGT
gtatctgaacacactcaatg

SEQ ID NO: 24226 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tcaatgttgggtccaacata

SEQ ID NO: 24227 - DNA, 20 bp, Artificial Sequence
  Description of Artificial Sequence: Synthetic oligonucleotide
  Target: ATXN1; (+) strand; PAM type: NNGRRT; PAM sequence: TTGGAT
atcaccccctacccaagcac

SEQ ID NO: 24228 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agaactttttttttttgaga

SEQ ID NO: 24229 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcacccaggc

SEQ ID NO: 24230 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaagtagc

SEQ ID NO: 24231 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcggcctcccaaagtgc

SEQ ID NO: 24232 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gccaccgcgcctggcctctc

SEQ ID NO: 24233 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ccacatagacttacatgttt

SEQ ID NO: 24234 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agttttaaagtacatgtgca

SEQ ID NO: 24235 - DNA, 20 bp, Artificial Sequence
  Description of Artificial Sequence: Synthetic oligonucleotide
  Target: ATXN1; (+) strand; PAM type: NNGRRT; PAM sequence: AAGAGT
acataagcaagagacttcct

SEQ ID NO: 24236 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gctttatatgtatttatttg

SEQ ID NO: 24237 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttatatattttagctgaact

SEQ ID NO: 24238 - DNA, 20 bp, Artificial Sequence
  Description of Artificial Sequence: Synthetic oligonucleotide
  Target: ATXN1; (+) strand; PAM type: NNGRRT; PAM sequence: ATGGGT
atttttaagaggctaccaac

SEQ ID NO: 24239 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ttgaccgccaaaaccaacca

SEQ ID NO: 24240 - DNA, 20 bp, Artificial Sequence
  Description of Artificial Sequence: Synthetic oligonucleotide
  Target: ATXN1; (+) strand; PAM type: NNGRRT; PAM sequence: TAGGGT
caatcacttcctcctgtgtt

SEQ ID NO: 24241 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ccaaaactaactgtggctgt

SEQ ID NO: 24242 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ctcatcagacagctgaagac

SEQ ID NO: 24243 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tattctggagatcacattga

SEQ ID NO: 24244 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tgtttatgacagacagactc

SEQ ID NO: 24245 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aggacaagcaaacctttcat

SEQ ID NO: 24246 - DNA, 20 bp, Artificial Sequence
  Description of Artificial Sequence: Synthetic oligonucleotide
  Target: ATXN1; (+) strand; PAM type: NNGRRT; PAM sequence: GAGGGT
atgcttggcaactagtgccg

SEQ ID NO: 24247 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tagtgccggagggttaacca

SEQ ID NO: 24248 - DNA, 20 bp, Artificial Sequence
  Description of Artificial Sequence: Synthetic oligonucleotide
  Target: ATXN1; (+) strand; PAM type: NNGRRT; PAM sequence: ATGGGT
caaattgctctgccgccacc

SEQ ID NO: 24249 - DNA, 20 bp, Artificial Sequence
  Description of Artificial Sequence: Synthetic oligonucleotide
  Target: ATXN1; (+) strand; PAM type: NNGRRT; PAM sequence: CAGGAT
caccatgggtattaacactc

SEQ ID NO: 24250 - DNA, 20 bp, Artificial Sequence
  Description of Artificial Sequence: Synthetic oligonucleotide
  Target: ATXN1; (+) strand; PAM type: NNGRRT; PAM sequence: AGGGGT
attatctgtgcccaagctgc

SEQ ID NO: 24251 - DNA, 20 bp, Artificial Sequence
  Description of Artificial Sequence: Synthetic oligonucleotide
  Target: ATXN1; (+) strand; PAM type: NNGRRT; PAM sequence: AGGGAT
atgatcacgcttgaaggcac

SEQ ID NO: 24252 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ggactattgtcaaaccttct

SEQ ID NO: 24253 - DNA, 20 bp, Artificial Sequence
  Description of Artificial Sequence: Synthetic oligonucleotide
  Target: ATXN1; (+) strand; PAM type: NNGRRT; PAM sequence: AGGGGT
agatcttagacttgcttgac

SEQ ID NO: 24254 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tcattttaaagttttcttta

SEQ ID NO: 24255 - DNA, 20 bp, Artificial Sequence
  Description of Artificial Sequence: Synthetic oligonucleotide
  Target: ATXN1; (+) strand; PAM type: NNGRRT; PAM sequence: TTGGAT
atgggagaccaagttcctta

SEQ ID NO: 24256 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tggattgcttcctgtggacc

SEQ ID NO: 24257 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ctagggacttattgaaactt

SEQ ID NO: 24258 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tgagagtcggaagtggtctg

SEQ ID NO: 24259 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcgcccaggc

SEQ ID NO: 24260 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gctggagtgcagtggctctc

SEQ ID NO: 24261 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atagagataatgtattctta

SEQ ID NO: 24262 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gaatatataattcaatttcc

SEQ ID NO: 24263 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ttatataacctataaaattt

SEQ ID NO: 24264 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gggctggttttttttttttg

SEQ ID NO: 24265 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ttttttttttttgaagaatt

SEQ ID NO: 24266 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ttaattcgccttcatgttct

SEQ ID NO: 24267 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gaaacaaatcagaagcacaa

SEQ ID NO: 24268 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ttgttacttactatgtggga

SEQ ID NO: 24269 - DNA, 20 bp, Artificial Sequence
  Description of Artificial Sequence: Synthetic oligonucleotide
  Target: ATXN1; (+) strand; PAM type: NNGRRT; PAM sequence: CAGAAT
acctccccgcccccattatt

SEQ ID NO: 24270 - DNA, 20 bp, Artificial Sequence
  Description of Artificial Sequence: Synthetic oligonucleotide
  Target: ATXN1; (+) strand; PAM type: NNGRRT; PAM sequence: TGGAGT
cccccattattcagaataag

SEQ ID NO: 24271 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aataagtggagtgtggagca

SEQ ID NO: 24272 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ccctttctggggaggaacaa

SEQ ID NO: 24273 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ttctggggaggaacaaatga

SEQ ID NO: 24274 - DNA, 20 bp, Artificial Sequence
  Description of Artificial Sequence: Synthetic oligonucleotide
  Target: ATXN1; (+) strand; PAM type: NNGRRT; PAM sequence: GGGAGT
taactagtgagggcatctta

SEQ ID NO: 24275 - DNA, 20 bp, Artificial Sequence
  Description of Artificial Sequence: Synthetic oligonucleotide
  Target: ATXN1; (+) strand; PAM type: NNGRRT; PAM sequence: AGGAAT
atgaggcatcttgatttgaa

SEQ ID NO: 24276 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aagccagcagtactccctgc

SEQ ID NO: 24277 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ccctgctagaatctgaagaa

SEQ ID NO: 24278 - DNA, 20 bp, Artificial Sequence
  Description of Artificial Sequence: Synthetic oligonucleotide
  Target: ATXN1; (+) strand; PAM type: NNGRRT; PAM sequence: GGGGGT
tttactggcaaggcctttca

SEQ ID NO: 24279 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gttatctctgttcttaaaaa

SEQ ID NO: 24280 - DNA, 20 bp, Artificial Sequence
  Description of Artificial Sequence: Synthetic oligonucleotide
  Target: ATXN1; (+) strand; PAM type: NNGRRT; PAM sequence: CCGAAT
tttaaaacaatatcttaata

SEQ ID NO: 24281 - DNA, 20 bp, Artificial Sequence
  Description of Artificial Sequence: Synthetic oligonucleotide
  Target: ATXN1; (+) strand; PAM type: NNGRRT; PAM sequence: CAGAGT
atcccaaaacatacataaca

SEQ ID NO: 24282 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ttcaaatctgataacgcact

SEQ ID NO: 24283 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tgataacgcactgtgaatta

SEQ ID NO: 24284 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aaagagatatttatatagaa

SEQ ID NO: 24285 - DNA, 20 bp, Artificial Sequence
  Description of Artificial Sequence: Synthetic oligonucleotide
  Target: ATXN1; (+) strand; PAM type: NNGRRT; PAM sequence: GCGGAT
aagggaattacttaggacat

SEQ ID NO: 24286 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctgagaacctcctttgtggc

SEQ ID NO: 24287 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taactttataaagtatttca

SEQ ID NO: 24288 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ttacaatgacactataagcc

SEQ ID NO: 24289 - DNA, 20 bp, Artificial Sequence
  Description of Artificial Sequence: Synthetic oligonucleotide
  Target: ATXN1; (+) strand; PAM type: NNGRRT; PAM sequence: TGGAAT
atgacactataagccttgga

SEQ ID NO: 24290 - DNA, 20 bp, Artificial Sequence
  Description of Artificial Sequence: Synthetic oligonucleotide
  Target: ATXN1; (+) strand; PAM type: NNGRRT; PAM sequence: CAGAGT
acaatcttaatgggaacaat

SEQ ID NO: 24291 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgcactactccatatgctca

SEQ ID NO: 24292 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctccatatgctcagagaatt

SEQ ID NO: 24293 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cgtgatgagaaaatttccac

SEQ ID NO: 24294 - DNA, 20 bp, Artificial Sequence
  Description of Artificial Sequence: Synthetic oligonucleotide
  Target: ATXN1; (+) strand; PAM type: NNGRRT; PAM sequence: TCGGGT
ccacatagaggtgatatata

SEQ ID NO: 24295 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tcgggtgatgacaagattgt

SEQ ID NO: 24296 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ggatgctaccaataaaatct

SEQ ID NO: 24297 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aactttagagagattaaact

SEQ ID NO: 24298 - DNA, 20 bp, Artificial Sequence
  Description of Artificial Sequence: Synthetic oligonucleotide
  Target: ATXN1; (+) strand; PAM type: NNGRRT; PAM sequence: ACGGAT
gttgtagaaaaagtttagaa

SEQ ID NO: 24299 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aaaaagtttagaaacggatt

SEQ ID NO: 24300 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaagaaaagacagtgacact

SEQ ID NO: 24301 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gcattttcgtataagcagcc

SEQ ID NO: 24302 - DNA, 20 bp, Artificial Sequence
  Description of Artificial Sequence: Synthetic oligonucleotide
  Target: ATXN1; (+) strand; PAM type: NNGRRT; PAM sequence: GAGGAT
cacacacacacacacacacg

SEQ ID NO: 24303 - DNA, 20 bp, Artificial Sequence
  Description of Artificial Sequence: Synthetic oligonucleotide
  Target: ATXN1; (+) strand; PAM type: NNGRRT; PAM sequence: AAGAAT
acggaggatacagcaccgtg

SEQ ID NO: 24304 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ttagtctgtatatttatatt

SEQ ID NO: 24305 - DNA, 20 bp, Artificial Sequence
  Description of Artificial Sequence: Synthetic oligonucleotide
  Target: ATXN1; (+) strand; PAM type: NNGRRT; PAM sequence: CTGAGT
atgggacaattccatgaaaa

SEQ ID NO: 24306 - DNA, 20 bp, Artificial Sequence
  Description of Artificial Sequence: Synthetic oligonucleotide
  Target: ATXN1; (+) strand; PAM type: NNGRRT; PAM sequence: GTGGGT
agttcacggagggccctcct

SEQ ID NO: 24307 - DNA, 20 bp, Artificial Sequence
  Description of Artificial Sequence: Synthetic oligonucleotide
  Target: ATXN1; (+) strand; PAM type: NNGRRT; PAM sequence: CTGGGT
cctcctgtgggttatgtatc

SEQ ID NO: 24308 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gagacagtaaaacaatattg

SEQ ID NO: 24309 - DNA, 20 bp, Artificial Sequence
  Description of Artificial Sequence: Synthetic oligonucleotide
  Target: ATXN1; (+) strand; PAM type: NNGRRT; PAM sequence: GAGAAT
caatattgatgaatttccat

SEQ ID NO: 24310 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ctaatgcgatatctgtctct

SEQ ID NO: 24311 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tcttggggtctcccatgctt

SEQ ID NO: 24312 - DNA, 20 bp, Artificial Sequence
  Description of Artificial Sequence: Synthetic oligonucleotide
  Target: ATXN1; (+) strand; PAM type: NNGRRT; PAM sequence: TAGGGT
agtgacagaaaaaatggaag

SEQ ID NO: 24313 - DNA, 20 bp, Artificial Sequence
  Description of Artificial Sequence: Synthetic oligonucleotide
  Target: ATXN1; (+) strand; PAM type: NNGRRT; PAM sequence: CAGAAT
actccagaggcaaggtggta

SEQ ID NO: 24314 - DNA, 20 bp, Artificial Sequence
  Description of Artificial Sequence: Synthetic oligonucleotide
  Target: ATXN1; (+) strand; PAM type: NNGRRT; PAM sequence: CTGGAT
aaggtggtacagaataccag

SEQ ID NO: 24315 - DNA, 20 bp, Artificial Sequence
  Description of Artificial Sequence: Synthetic oligonucleotide
  Target: ATXN1; (+) strand; PAM type: NNGRRT; PAM sequence: GAGGGT
agttcaaagcttccctagtt

SEQ ID NO: 24316 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tacctgcttaacactatagg

SEQ ID NO: 24317 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ataatattgcaaacccaaaa

SEQ ID NO: 24318 - DNA, 20 bp, Artificial Sequence
  Description of Artificial Sequence: Synthetic oligonucleotide
  Target: ATXN1; (+) strand; PAM type: NNGRRT; PAM sequence: GAGAAT
acagggtaattgtgcaaaga

SEQ ID NO: 24319 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcccctttccagaaaatatt

SEQ ID NO: 24320 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgtgtatgtacatatatagt

SEQ ID NO: 24321 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctgcttttcctatatgcagc

SEQ ID NO: 24322 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tgaagacaatacatactctt

SEQ ID NO: 24323 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tactcttttggatggagctg

SEQ ID NO: 24324 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gtgttttggaactgcaatac

SEQ ID NO: 24325 - DNA, 20 bp, Artificial Sequence
  Description of Artificial Sequence: Synthetic oligonucleotide
  Target: ATXN1; (+) strand; PAM type: NNGRRT; PAM sequence: TGGGGT
actcatgaggaaagcaagtc

SEQ ID NO: 24326 - DNA, 20 bp, Artificial Sequence
  Description of Artificial Sequence: Synthetic oligonucleotide
  Target: ATXN1; (+) strand; PAM type: NNGRRT; PAM sequence: AGGAGT
actgttgtatcaaaatggga

SEQ ID NO: 24327 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gtaagtttttacttttgaga

SEQ ID NO: 24328 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gccacaaactcctgggccca

SEQ ID NO: 24329 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tttttttttttttgtagaga

SEQ ID NO: 24330 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ctgtcaaactcctgggctca

SEQ ID NO: 24331 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aataataattgcatgtagtt

SEQ ID NO: 24332 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ccttattatgagggctaaaa

SEQ ID NO: 24333 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aatattaataatcctgtaca

SEQ ID NO: 24334 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tcctcatttttgtcttcatt

SEQ ID NO: 24335 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gagaggaagatgacacaagc

SEQ ID NO: 24336 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ggaagatgaaacaaaccact

SEQ ID NO: 24337 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tcaggattctgaagggaaca

SEQ ID NO: 24338 - DNA, 20 bp, Artificial Sequence
  Description of Artificial Sequence: Synthetic oligonucleotide
  Target: ATXN1; (+) strand; PAM type: NNGRRT; PAM sequence: TTGGGT
attctgaagggaacactggg

SEQ ID NO: 24339 - DNA, 20 bp, Artificial Sequence
  Description of Artificial Sequence: Synthetic oligonucleotide
  Target: ATXN1; (+) strand; PAM type: NNGRRT; PAM sequence: CGGGGT
tttattatttgtcttagaga

SEQ ID NO: 24340 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aaatactgtttttgctctga

SEQ ID NO: 24341 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gtagcctcaaagaggaggaa

SEQ ID NO: 24342 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gagtcatgatgagcttgatt

SEQ ID NO: 24343 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ctccactggcaactagatgt

SEQ ID NO: 24344 - DNA, 20 bp, Artificial Sequence
  Description of Artificial Sequence: Synthetic oligonucleotide
  Target: ATXN1; (+) strand; PAM type: NNGRRT; PAM sequence: AGGGAT
acattgattcctattaccag

SEQ ID NO: 24345 - DNA, 20 bp, Artificial Sequence
  Description of Artificial Sequence: Synthetic oligonucleotide
  Target: ATXN1; (+) strand; PAM type: NNGRRT; PAM sequence: GAGGAT
atatgttataaaccagggga

SEQ ID NO: 24346 - DNA, 20 bp, Artificial Sequence
  Description of Artificial Sequence: Synthetic oligonucleotide
  Target: ATXN1; (+) strand; PAM type: NNGRRT; PAM sequence: ATGAAT
actcaagtgtttaggaacat

SEQ ID NO: 24347 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gtttaggaacatatgaatca

SEQ ID NO: 24348 - DNA, 20 bp, Artificial Sequence
  Description of Artificial Sequence: Synthetic oligonucleotide
  Target: ATXN1; (+) strand; PAM type: NNGRRT; PAM sequence: GAGAGT
aaaacggaggtggaaagagg

SEQ ID NO: 24349 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gacctgaccatactgtgggg

SEQ ID NO: 24350 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ccccagatttcattttagga

SEQ ID NO: 24351 - DNA, 20 bp, Artificial Sequence
  Description of Artificial Sequence: Synthetic oligonucleotide
  Target: ATXN1; (+) strand; PAM type: NNGRRT; PAM sequence: GAGAAT
atgactaagctctgaaaact

SEQ ID NO: 24352 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gataagaaggaagacagtaa

SEQ ID NO: 24353 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgaaaaagatggtgccaggt

SEQ ID NO: 24354 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gtgtcgcagaaatatccctt

SEQ ID NO: 24355 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aagtaaaatttactgaaagg

SEQ ID NO: 24356 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gctgaataaaaacttccaca

SEQ ID NO: 24357 - DNA, 20 bp, Artificial Sequence
  Description of Artificial Sequence: Synthetic oligonucleotide
  Target: ATXN1; (+) strand; PAM type: NNGRRT; PAM sequence: GAGAGT
taaaaccacattaaaagatt

SEQ ID NO: 24358 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tagttaagccagcatagttc

SEQ ID NO: 24359 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aatgtcaagaaaacatgtta

SEQ ID NO: 24360 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gtcactgtttatgccttggc

SEQ ID NO: 24361 - DNA, 20 bp, Artificial Sequence
  Description of Artificial Sequence: Synthetic oligonucleotide
  Target: ATXN1; (+) strand; PAM type: NNGRRT; PAM sequence: TCGAAT
gtgcctccaaaattcacatg

SEQ ID NO: 24362 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ctccccacgtgatagtatta

SEQ ID NO: 24363 - DNA, 20 bp, Artificial Sequence
  Description of Artificial Sequence: Synthetic oligonucleotide
  Target: ATXN1; (+) strand; PAM type: NNGRRT; PAM sequence: TTGAAT
agcccttgggaggtgccctc

SEQ ID NO: 24364 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttgggaggtgccctcttgaa

SEQ ID NO: 24365 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ctttgcctcttccaccatgt

SEQ ID NO: 24366 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gtgagccttagaacaagcct

SEQ ID NO: 24367 - DNA, 20 bp, Artificial Sequence
  Description of Artificial Sequence: Synthetic oligonucleotide
  Target: ATXN1; (+) strand; PAM type: NNGRRT; PAM sequence: CCGGGT
agaacaagccttagaatagg

SEQ ID NO: 24368 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggcagatcacctgacatc

SEQ ID NO: 24369 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tactcaggaggctgagacag

SEQ ID NO: 24370 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aagtaatctgtatgattact

SEQ ID NO: 24371 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ttaacacacacattcatatg

SEQ ID NO: 24372 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tttctaaaacatgaaggcta

SEQ ID NO: 24373 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aagatctcaaattggcagat

SEQ ID NO: 24374 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gtctttgcagatgggaagat

SEQ ID NO: 24375 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aagctcagtgtatctgtaca

SEQ ID NO: 24376 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gtagccatgtagcataatgg

SEQ ID NO: 24377 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gtggcctcagctctgaagat

SEQ ID NO: 24378 - DNA, 20 bp, Artificial Sequence
  Description of Artificial Sequence: Synthetic oligonucleotide
  Target: ATXN1; (+) strand; PAM type: NNGRRT; PAM sequence: GAGGAT
cctactaacagggccactgt

SEQ ID NO: 24379 - DNA, 20 bp, Artificial Sequence
  Description of Artificial Sequence: Synthetic oligonucleotide
  Target: ATXN1; (+) strand; PAM type: NNGRRT; PAM sequence: ATGAGT
agggccactgtgaggattaa

SEQ ID NO: 24380 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttgaaatactaaaaagagca

SEQ ID NO: 24381 - DNA, 20 bp, Artificial Sequence
  Description of Artificial Sequence: Synthetic oligonucleotide
  Target: ATXN1; (+) strand; PAM type: NNGRRT; PAM sequence: TGGGAT
actgtcctcatctgtaaaaa

SEQ ID NO: 24382 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gctatatataccatgtacat

SEQ ID NO: 24383 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tattccattctctcctgcct

SEQ ID NO: 24384 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ggtgacctaggaaaagcaca

SEQ ID NO: 24385 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ccacccccagtcacccttca

SEQ ID NO: 24386 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gtaaaaaatacagtccaccc

SEQ ID NO: 24387 - DNA, 20 bp, Artificial Sequence
  Description of Artificial Sequence: Synthetic oligonucleotide
  Target: ATXN1; (+) strand; PAM type: NNGRRT; PAM sequence: TGGGAT
caccctagggtaggaaaaac

SEQ ID NO: 24388 - DNA, 20 bp, Artificial Sequence
  Description of Artificial Sequence: Synthetic oligonucleotide
  Target: ATXN1; (+) strand; PAM type: NNGRRT; PAM sequence: AAGGAT
cttggccttgcctaatcttc

SEQ ID NO: 24389 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aatagacttttgttcttgct

SEQ ID NO: 24390 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gacttttgttcttgctaaga

SEQ ID NO: 24391 - DNA, 20 bp, Artificial Sequence
  Description of Artificial Sequence: Synthetic oligonucleotide
  Target: ATXN1; (+) strand; PAM type: NNGRRT; PAM sequence: AGGAGT
actcaaaaatataaaaacag

SEQ ID NO: 24392 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ggaaattaacatttagttta

SEQ ID NO: 24393 - DNA, 20 bp, Artificial Sequence
  Description of Artificial Sequence: Synthetic oligonucleotide
  Target: ATXN1; (+) strand; PAM type: NNGRRT; PAM sequence: CGGAGT
ttttttttttttttaagaga

SEQ ID NO: 24394 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gtctcgctctgtcgccaggc

SEQ ID NO: 24395 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagcctcccaagtagc

SEQ ID NO: 24396 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tttttgtattttagtggagg

SEQ ID NO: 24397 - DNA, 20 bp, Artificial Sequence
  Description of Artificial Sequence: Synthetic oligonucleotide
  Target: ATXN1; (+) strand; PAM type: NNGRRT; PAM sequence: GAGAAT
caactcacatctcctctctg

SEQ ID NO: 24398 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ctctggagaattcctgataa

SEQ ID NO: 24399 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttttagacagtcctgattgc

SEQ ID NO: 24400 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ccagaatgttcctcctcaag

SEQ ID NO: 24401 - DNA, 20 bp, Artificial Sequence
  Description of Artificial Sequence: Synthetic oligonucleotide
  Target: ATXN1; (+) strand; PAM type: NNGRRT; PAM sequence: TAGGGT
aagtggagtcgaactctccc

SEQ ID NO: 24402 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcatggtcctaaggccatta

SEQ ID NO: 24403 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tgggatattttggactttac

SEQ ID NO: 24404 - DNA, 20 bp, Artificial Sequence
  Description of Artificial Sequence: Synthetic oligonucleotide
  Target: ATXN1; (+) strand; PAM type: NNGRRT; PAM sequence: AAGGAT
agacttacaatctttctgaa

SEQ ID NO: 24405 - DNA, 20 bp, Artificial Sequence
  Description of Artificial Sequence: Synthetic oligonucleotide
  Target: ATXN1; (+) strand; PAM type: NNGRRT; PAM sequence: TGGAAT
agatgactacctctgtttcc

SEQ ID NO: 24406 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tagtaccttcatcttgagag

SEQ ID NO: 24407 - DNA, 20 bp, Artificial Sequence
  Description of Artificial Sequence: Synthetic oligonucleotide
  Target: ATXN1; (+) strand; PAM type: NNGRRT; PAM sequence: TGGAAT
taaaaatgcagcctgggcaa

SEQ ID NO: 24408 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tactcagcaggctgaggcgg

SEQ ID NO: 24409 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggaggatcactggagccc

SEQ ID NO: 24410 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctaccctctggcctgggcaa

SEQ ID NO: 24411 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ctatatatacaaataaataa

SEQ ID NO: 24412 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tcaccactcagaacatggct

SEQ ID NO: 24413 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ctggctaggtggagagagct

SEQ ID NO: 24414 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aggtggagagagctaggaat

SEQ ID NO: 24415 - DNA, 20 bp, Artificial Sequence
  Description of Artificial Sequence: Synthetic oligonucleotide
  Target: ATXN1; (+) strand; PAM type: NNGRRT; PAM sequence: AAGAAT
acagaggctgtggcatcgag

SEQ ID NO: 24416 - DNA, 20 bp, Artificial Sequence
  Description of Artificial Sequence: Synthetic oligonucleotide
  Target: ATXN1; (+) strand; PAM type: NNGRRT; PAM sequence: TTGAGT
atgatttctgccggaaaatg

SEQ ID NO: 24417 - DNA, 20 bp, Artificial Sequence
  Description of Artificial Sequence: Synthetic oligonucleotide
  Target: ATXN1; (+) strand; PAM type: NNGRRT; PAM sequence: CTGAGT
taatgcatttaaataatatt

SEQ ID NO: 24418 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tatctggaagcagttatttc

SEQ ID NO: 24419 - DNA, 20 bp, Artificial Sequence
  Description of Artificial Sequence: Synthetic oligonucleotide
  Target: ATXN1; (+) strand; PAM type: NNGRRT; PAM sequence: GTGAAT
atatggaagtaagaacaaaa

SEQ ID NO: 24420 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ataatcattgaggaactctt

SEQ ID NO: 24421 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctccagcttaggcgacctga

SEQ ID NO: 24422 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aatttttaaaaccctctttt

SEQ ID NO: 24423 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aaaagactagatgtgtgttg

SEQ ID NO: 24424 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aacatggtagttccatcagt

SEQ ID NO: 24425 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tgggacaccacactgtcaca

SEQ ID NO: 24426 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cgccacagtggagctagtaa

SEQ ID NO: 24427 - DNA, 20 bp, Artificial Sequence
  Description of Artificial Sequence: Synthetic oligonucleotide
  Target: ATXN1; (+) strand; PAM type: NNGRRT; PAM sequence: CGGGAT
taacagagtgttagtattag

SEQ ID NO: 24428 - DNA, 20 bp, Artificial Sequence
  Description of Artificial Sequence: Synthetic oligonucleotide
  Target: ATXN1; (+) strand; PAM type: NNGRRT; PAM sequence: ATGAAT
agagtgttagtattagcggg

SEQ ID NO: 24429 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cacctgctggtgcaatttag

SEQ ID NO: 24430 - DNA, 20 bp, Artificial Sequence
  Description of Artificial Sequence: Synthetic oligonucleotide
  Target: ATXN1; (+) strand; PAM type: NNGRRT; PAM sequence: ATGAAT
agttaattttgctttagatt

SEQ ID NO: 24431 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ccagttaaggagacgccatt

SEQ ID NO: 24432 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gaaccaaacatttcttcctt

SEQ ID NO: 24433 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ctcttctaacaaagccaaac

SEQ ID NO: 24434 - DNA, 20 bp, Artificial Sequence
  Description of Artificial Sequence: Synthetic oligonucleotide
  Target: ATXN1; (+) strand; PAM type: NNGRRT; PAM sequence: AGGAAT
acagcacctaagttcaaatt

SEQ ID NO: 24435 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gtcccaataaccaatgggac

SEQ ID NO: 24436 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ggaagctttgccccagagag

SEQ ID NO: 24437 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tattgccaggagcaccggga

SEQ ID NO: 24438 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gttaacttttcacctgtatt

SEQ ID NO: 24439 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taacatgtgaggaagctgaa

SEQ ID NO: 24440 - DNA, 20 bp, Artificial Sequence
  Description of Artificial Sequence: Synthetic oligonucleotide
  Target: ATXN1; (+) strand; PAM type: NNGRRT; PAM sequence: GTGGAT
caaataaaccttttgctaaa

SEQ ID NO: 24441 - DNA, 20 bp, Artificial Sequence
  Description of Artificial Sequence: Synthetic oligonucleotide
  Target: ATXN1; (+) strand; PAM type: NNGRRT; PAM sequence: GAGAAT
agaaactgttcttgaagtat

SEQ ID NO: 24442 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tgaaggaaaagcattaaatt

SEQ ID NO: 24443 - DNA, 20 bp, Artificial Sequence
  Description of Artificial Sequence: Synthetic oligonucleotide
  Target: ATXN1; (+) strand; PAM type: NNGRRT; PAM sequence: TGGAGT
aaagcattaaattaggagtc

SEQ ID NO: 24444 - DNA, 20 bp, Artificial Sequence
  Description of Artificial Sequence: Synthetic oligonucleotide
  Target: ATXN1; (+) strand; PAM type: NNGRRT; PAM sequence: AGGAGT
acaaacaggctgtgtgttgt

SEQ ID NO: 24445 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ggcagaaaatctaaccagaa

SEQ ID NO: 24446 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gtacagcttaccactaagca

SEQ ID NO: 24447 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tgtgccagcatgttactttc

SEQ ID NO: 24448 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tagaaatctcaagctcgtca

SEQ ID NO: 24449 - DNA, 20 bp, Artificial Sequence
  Description of Artificial Sequence: Synthetic oligonucleotide
  Target: ATXN1; (+) strand; PAM type: NNGRRT; PAM sequence: TTGAGT
accattcaatgttttacaaa

SEQ ID NO: 24450 - DNA, 20 bp, Artificial Sequence
  Description of Artificial Sequence: Synthetic oligonucleotide
  Target: ATXN1; (+) strand; PAM type: NNGRRT; PAM sequence: AGGAGT
taaagagaacactgaaggtt

SEQ ID NO: 24451 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actgaaggttaggagtaggt

SEQ ID NO: 24452 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ggaagaacaaacatgtccgg

SEQ ID NO: 24453 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aattcagagctagattccaa

SEQ ID NO: 24454 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cagctttacctttgactcat

SEQ ID NO: 24455 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gtgaggtctgaaaactgttt

SEQ ID NO: 24456 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgtttgtgggtcatagtaaa

SEQ ID NO: 24457 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aatgtcagactcgcatgatt

SEQ ID NO: 24458 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agactcgcatgattctgagt

SEQ ID NO: 24459 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cagtaggaagcaacacagta

SEQ ID NO: 24460 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aataaaattcttaatccgct

SEQ ID NO: 24461 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aacacactacttaaaataaa

SEQ ID NO: 24462 - DNA, 20 bp, Artificial Sequence
  Description of Artificial Sequence: Synthetic oligonucleotide
  Target: ATXN1; (+) strand; PAM type: NNGRRT; PAM sequence: CTGAAT
atgacacctaaaatgatccg

SEQ ID NO: 24463 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tttcccaattaaaaaaatcc

SEQ ID NO: 24464 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agcaaggtgctcaactcttg

SEQ ID NO: 24465 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aatagtattggcaaggactt

SEQ ID NO: 24466 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gggatgtacttctctgcatc

SEQ ID NO: 24467 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gcctgacaacatgatcaaag

SEQ ID NO: 24468 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cagaagtcctgagatagctg

SEQ ID NO: 24469 - DNA, 20 bp, Artificial Sequence
  Description of Artificial Sequence: Synthetic oligonucleotide
  Target: ATXN1; (+) strand; PAM type: NNGRRT; PAM sequence: GGGAAT
ggtgaaaactgctcaccgat

SEQ ID NO: 24470 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gggaattgaggagctaggta

SEQ ID NO: 24471 - DNA, 20 bp, Artificial Sequence
  Description of Artificial Sequence: Synthetic oligonucleotide
  Target: ATXN1; (+) strand; PAM type: NNGRRT; PAM sequence: GGGGAT
agctaggtagaggatggaaa

SEQ ID NO: 24472 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ctgggctgcagatcagcccg

SEQ ID NO: 24473 - DNA, 20 bp, Artificial Sequence
  Description of Artificial Sequence: Synthetic oligonucleotide
  Target: ATXN1; (+) strand; PAM type: NNGRRT; PAM sequence: GTGAGT
agctgctaggctttgcttct

SEQ ID NO: 24474 - DNA, 20 bp, Artificial Sequence
  Description of Artificial Sequence: Synthetic oligonucleotide
  Target: ATXN1; (+) strand; PAM type: NNGRRT; PAM sequence: TGGAAT
gttttagcacctttaaactc

SEQ ID NO: 24475 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aaacaaaaagcagcgacctc

SEQ ID NO: 24476 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aacagaagcgaggtttggga

SEQ ID NO: 24477 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttgggaggggatgttggcat

SEQ ID NO: 24478 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gcatcagggtgataaaccct

SEQ ID NO: 24479 - DNA, 20 bp, Artificial Sequence
  Description of Artificial Sequence: Synthetic oligonucleotide
  Target: ATXN1; (+) strand; PAM type: NNGRRT; PAM sequence: ATGAAT
accctaaaaataaaccacca

SEQ ID NO: 24480 - DNA, 20 bp, Artificial Sequence
  Description of Artificial Sequence: Synthetic oligonucleotide
  Target: ATXN1; (+) strand; PAM type: NNGRRT; PAM sequence: GGGAAT
actaacaacagactagccca

SEQ ID NO: 24481 - DNA, 20 bp, Artificial Sequence
  Description of Artificial Sequence: Synthetic oligonucleotide
  Target: ATXN1; (+) strand; PAM type: NNGRRT; PAM sequence: AGGAGT
acggggcagagaaggggaga

SEQ ID NO: 24482 - DNA, 20 bp, Artificial Sequence
  Description of Artificial Sequence: Synthetic oligonucleotide
  Target: ATXN1; (+) strand; PAM type: NNGRRT; PAM sequence: AGGGAT
aattcctttacacacaagac

SEQ ID NO: 24483 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tcaggcaggagaaggaaata

SEQ ID NO: 24484 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aagcaacgtcagcaaagtct

SEQ ID NO: 24485 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gacaaacagagagccaaatc

SEQ ID NO: 24486 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctattcacaactgcttcaaa

SEQ ID NO: 24487 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tcaaagagaataaaatacct

SEQ ID NO: 24488 - DNA, 20 bp, Artificial Sequence
  Description of Artificial Sequence: Synthetic oligonucleotide
  Target: ATXN1; (+) strand; PAM type: NNGRRT; PAM sequence: AGGGAT
acctaggaatccaacttaca

SEQ ID NO: 24489 - DNA, 20 bp, Artificial Sequence
  Description of Artificial Sequence: Synthetic oligonucleotide
  Target: ATXN1; (+) strand; PAM type: NNGRRT; PAM sequence: GAGGAT
cactgctcaacgaaataaaa

SEQ ID NO: 24490 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gctaccaatgactttcttca

SEQ ID NO: 24491 - DNA, 20 bp, Artificial Sequence
  Description of Artificial Sequence: Synthetic oligonucleotide
  Target: ATXN1; (+) strand; PAM type: NNGRRT; PAM sequence: AAGGAT
acaaaaacaagaaatgggga

SEQ ID NO: 24492 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tatacaaaaattaattcaag

SEQ ID NO: 24493 - DNA, 20 bp, Artificial Sequence
  Description of Artificial Sequence: Synthetic oligonucleotide
  Target: ATXN1; (+) strand; PAM type: NNGRRT; PAM sequence: TGGGAT
caaaagccaaaattgtcaaa

SEQ ID NO: 24494 - DNA, 20 bp, Artificial Sequence
  Description of Artificial Sequence: Synthetic oligonucleotide
  Target: ATXN1; (+) strand; PAM type: NNGRRT; PAM sequence: CGGAGT
acagccaaagaaactaccat

SEQ ID NO: 24495 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cggagtgaacaggcaaccta

SEQ ID NO: 24496 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tcggacaaagggctaatatc

SEQ ID NO: 24497 - DNA, 20 bp, Artificial Sequence
  Description of Artificial Sequence: Synthetic oligonucleotide
  Target: ATXN1; (+) strand; PAM type: NNGRRT; PAM sequence: AAGGAT
accccatcaaaaagtgggcg

SEQ ID NO: 24498 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tcaaaaagtgggcgaaggat

SEQ ID NO: 24499 - DNA, 20 bp, Artificial Sequence
  Description of Artificial Sequence: Synthetic oligonucleotide
  Target: ATXN1; (+) strand; PAM type: NNGRRT; PAM sequence: TAGAAT
acataccatctcacaccagt

SEQ ID NO: 24500 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aggaaacaacaggtgctgga

SEQ ID NO: 24501 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agtcagtgtggcgattcctc

SEQ ID NO: 24502 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttgacccagccatcccatta

SEQ ID NO: 24503 - DNA, 20 bp, Artificial Sequence
  Description of Artificial Sequence: Synthetic oligonucleotide
  Target: ATXN1; (+) strand; PAM type: NNGRRT; PAM sequence: AGGAGT
attactgggtatataccaaa

SEQ ID NO: 24504 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aatgtggcacatacacacca

SEQ ID NO: 24505 - DNA, 20 bp, Artificial Sequence
  Description of Artificial Sequence: Synthetic oligonucleotide
  Target: ATXN1; (+) strand; PAM type: NNGRRT; PAM sequence: ATGAGT
ctatgcagccataaaaaatg

SEQ ID NO: 24506 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ttcatgtcctttgtagggac

SEQ ID NO: 24507 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gcatgttctcactcataggt

SEQ ID NO: 24508 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ccacaccccagggcctgttg

SEQ ID NO: 24509 - DNA, 20 bp, Artificial Sequence
  Description of Artificial Sequence: Synthetic oligonucleotide
  Target: ATXN1; (+) strand; PAM type: NNGRRT; PAM sequence: AGGGAT
gtggggtggggggaaggggg

SEQ ID NO: 24510 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ctaatgtaaatgacgattta

SEQ ID NO: 24511 - DNA, 20 bp, Artificial Sequence
  Description of Artificial Sequence: Synthetic oligonucleotide
  Target: ATXN1; (+) strand; PAM type: NNGRRT; PAM sequence: GGGGGT
caatgactatactgggctgt

SEQ ID NO: 24512 - DNA, 20 bp, Artificial Sequence
  Description of Artificial Sequence: Synthetic oligonucleotide
  Target: ATXN1; (+) strand; PAM type: NNGRRT; PAM sequence: GTGAAT
taataaatagtacatctatg

SEQ ID NO: 24513 - DNA, 20 bp, Artificial Sequence
  Description of Artificial Sequence: Synthetic oligonucleotide
  Target: ATXN1; (+) strand; PAM type: NNGRRT; PAM sequence: GTGGGT
catatttaaaaatggttaaa

SEQ ID NO: 24514 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cggcactttgggaggccgag

SEQ ID NO: 24515 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccgaggcgg

SEQ ID NO: 24516 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggtggatcacctgaggtc

SEQ ID NO: 24517 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tactaaaaatacaaaactag

SEQ ID NO: 24518 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacccgggagcctgagccag

SEQ ID NO: 24519 - DNA, 20 bp, Artificial Sequence
  Description of Artificial Sequence: Synthetic oligonucleotide
  Target: ATXN1; (+) strand; PAM type: NNGRRT; PAM sequence: GGGGGT
aggagaattgcttgaacctg

SEQ ID NO: 24520 - DNA, 20 bp, Artificial Sequence
  Description of Artificial Sequence: Synthetic oligonucleotide
  Target: ATXN1; (+) strand; PAM type: NNGRRT; PAM sequence: TTGAGT
ttaaagcagcagcttttatg

SEQ ID NO: 24521 - DNA, 20 bp, Artificial Sequence
  Description of Artificial Sequence: Synthetic oligonucleotide
  Target: ATXN1; (+) strand; PAM type: NNGRRT; PAM sequence: ACGAAT
cgtcatggagcccacactgt

SEQ ID NO: 24522 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gaatgttttggaggtgcgca

SEQ ID NO: 24523 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgagttaaaaataaaaaaca

SEQ ID NO: 24524 - DNA, 20 bp, Artificial Sequence
  Description of Artificial Sequence: Synthetic oligonucleotide
  Target: ATXN1; (+) strand; PAM type: NNGRRT; PAM sequence: TCGGGT
agtacagtttccatttctac

SEQ ID NO: 24525 - DNA, 20 bp, Artificial Sequence
  Description of Artificial Sequence: Synthetic oligonucleotide
  Target: ATXN1; (+) strand; PAM type: NNGRRT; PAM sequence: CAGAAT
caagattgactgtcggtcta

SEQ ID NO: 24526 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tcctgcgaggcgctccctct

SEQ ID NO: 24527 - DNA, 20 bp, Artificial Sequence
  Description of Artificial Sequence: Synthetic oligonucleotide
  Target: ATXN1; (+) strand; PAM type: NNGRRT; PAM sequence: CGGGGT
gtgcaatgtgattctacacc

SEQ ID NO: 24528 - DNA, 20 bp, Artificial Sequence
  Description of Artificial Sequence: Synthetic oligonucleotide
  Target: ATXN1; (+) strand; PAM type: NNGRRT; PAM sequence: TGGAAT
accccaaacaagggggctgc

SEQ ID NO: 24529 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gcacagtgcaaaacagacca

SEQ ID NO: 24530 - DNA, 20 bp, Artificial Sequence
  Description of Artificial Sequence: Synthetic oligonucleotide
  Target: ATXN1; (+) strand; PAM type: NNGRRT; PAM sequence: TAGAGT
ccctacccgctggagcatcc

SEQ ID NO: 24531 - DNA, 20 bp, Artificial Sequence
  Description of Artificial Sequence: Synthetic oligonucleotide
  Target: ATXN1; (+) strand; PAM type: NNGRRT; PAM sequence: AGGAAT
catcctagagtctctgtgac

SEQ ID NO: 24532 - DNA, 20 bp, Artificial Sequence
  Description of Artificial Sequence: Synthetic oligonucleotide
  Target: ATXN1; (+) strand; PAM type: NNGRRT; PAM sequence: AGGGAT
gggagggctaaagtgaaggc

SEQ ID NO: 24533 - DNA, 20 bp, Artificial Sequence
  Description of Artificial Sequence: Synthetic oligonucleotide
  Target: ATXN1; (+) strand; PAM type: NNGRRT; PAM sequence: GAGGGT
taaagtgaaggcagggatca

SEQ ID NO: 24534 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gagcaaagaaattaatgata

SEQ ID NO: 24535 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggttttagggaaagagatat

SEQ ID NO: 24536 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tcaacagtcacagacccaaa

SEQ ID NO: 24537 - DNA, 20 bp, Artificial Sequence
  Description of Artificial Sequence: Synthetic oligonucleotide
  Target: ATXN1; (+) strand; PAM type: NNGRRT; PAM sequence: CAGAAT
acccaaactgaatgatggag

SEQ ID NO: 24538 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ctcttggttccccaatcaca

SEQ ID NO: 24539 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aagcaggtgctctgtggttc

SEQ ID NO: 24540 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tttcaacattcctctgtcac

SEQ ID NO: 24541 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tgccaaatgcatagcactaa

SEQ ID NO: 24542 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttttcacatccctacagtcc

SEQ ID NO: 24543 - DNA, 20 bp, Artificial Sequence
  Description of Artificial Sequence: Synthetic oligonucleotide
  Target: ATXN1; (+) strand; PAM type: NNGRRT; PAM sequence: ATGGGT
cacatccctacagtccttga

SEQ ID NO: 24544 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tttagcctcaatacctagag

SEQ ID NO: 24545 - DNA, 20 bp, Artificial Sequence
  Description of Artificial Sequence: Synthetic oligonucleotide
  Target: ATXN1; (+) strand; PAM type: NNGRRT; PAM sequence: TTGAAT
acgtatgcaagaaatctttg

SEQ ID NO: 24546 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaatctttgttgaattaatg

SEQ ID NO: 24547 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccgaggcaa

SEQ ID NO: 24548 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ggcaagtggatcacgaggtc

SEQ ID NO: 24549 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggagactgaggcag

SEQ ID NO: 24550 - DNA, 20 bp, Artificial Sequence
  Description of Artificial Sequence: Synthetic oligonucleotide
  Target: ATXN1; (+) strand; PAM type: NNGRRT; PAM sequence: GAGGGT
agaaagaaagaggaccctga

SEQ ID NO: 24551 - DNA, 20 bp, Artificial Sequence
  Description of Artificial Sequence: Synthetic oligonucleotide
  Target: ATXN1; (+) strand; PAM type: NNGRRT; PAM sequence: AAGAAT
taaataaaccagactgggac

SEQ ID NO: 24552 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aggcctcctaactttctctg

SEQ ID NO: 24553 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tacagttttcctaacagcta

SEQ ID NO: 24554 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aaaagaagttgttcctcctc

SEQ ID NO: 24555 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttggtaagaagtcatgcaaa

SEQ ID NO: 24556 - DNA, 20 bp, Artificial Sequence
  Description of Artificial Sequence: Synthetic oligonucleotide
  Target: ATXN1; (+) strand; PAM type: NNGRRT; PAM sequence: GAGAAT
aaatggaatttgggagggaa

SEQ ID NO: 24557 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gaatttgggagggaagagaa

SEQ ID NO: 24558 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aaagtctcctggacttcttc

SEQ ID NO: 24559 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tctgtctcaataacacccca

SEQ ID NO: 24560 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tctatcttctactctgccca

SEQ ID NO: 24561 - DNA, 20 bp, Artificial Sequence
  Description of Artificial Sequence: Synthetic oligonucleotide
  Target: ATXN1; (+) strand; PAM type: NNGRRT; PAM sequence: GAGAGT
ggctagaggttgatgcagct

SEQ ID NO: 24562 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gagttattttccatgtgatg

SEQ ID NO: 24563 - DNA, 20 bp, Artificial Sequence
  Description of Artificial Sequence: Synthetic oligonucleotide
  Target: ATXN1; (+) strand; PAM type: NNGRRT; PAM sequence: ATGAGT
agagaagaggtccaatggtt

SEQ ID NO: 24564 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ggtccaatggttatgagtgg

SEQ ID NO: 24565 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aataaaggtataaatgctac

SEQ ID NO: 24566 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ttaataaaaatgattacagt

SEQ ID NO: 24567 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aatgattacagtaaggataa

SEQ ID NO: 24568 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cacaatatgtggtggggggg

SEQ ID NO: 24569 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gcaaaactaaaaacaaaaac

SEQ ID NO: 24570 - DNA, 20 bp, Artificial Sequence
  Description of Artificial Sequence: Synthetic oligonucleotide
  Target: ATXN1; (+) strand; PAM type: NNGRRT; PAM sequence: CTGAAT
acaaaaaccaggatagcact

SEQ ID NO: 24571 - DNA, 20 bp, Artificial Sequence
  Description of Artificial Sequence: Synthetic oligonucleotide
  Target: ATXN1; (+) strand; PAM type: NNGRRT; PAM sequence: TGGAAT
actctgaatatcagacaaaa

SEQ ID NO: 24572 - DNA, 20 bp, Artificial Sequence
  Description of Artificial Sequence: Synthetic oligonucleotide
  Target: ATXN1; (+) strand; PAM type: NNGRRT; PAM sequence: GTGAAT
cttaaaaattccccacgtct

SEQ ID NO: 24573 - DNA, 20 bp, Artificial Sequence
  Description of Artificial Sequence: Synthetic oligonucleotide
  Target: ATXN1; (+) strand; PAM type: NNGRRT; PAM sequence: CTGAGT
taaaatggaaatacaaaata

SEQ ID NO: 24574 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tcagtagatttctagacaag

SEQ ID NO: 24575 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttctagacaaggagaattgc

SEQ ID NO: 24576 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aaggagaattgccagagtta

SEQ ID NO: 24577 - DNA, 20 bp, Artificial Sequence
  Description of Artificial Sequence: Synthetic oligonucleotide
  Target: ATXN1; (+) strand; PAM type: NNGRRT; PAM sequence: AAGGGT
gggtcatttcataataatta

SEQ ID NO: 24578 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggtggaacacctgaggtc

SEQ ID NO: 24579 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggaggctgaggcag

SEQ ID NO: 24580 - DNA, 20 bp, Artificial Sequence
  Description of Artificial Sequence: Synthetic oligonucleotide
  Target: ATXN1; (+) strand; PAM type: NNGRRT; PAM sequence: CAGAGT
aatcacttgaacccagggaa

SEQ ID NO: 24581 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttgtgccactgaactccagc

SEQ ID NO: 24582 - DNA, 20 bp, Artificial Sequence
  Description of Artificial Sequence: Synthetic oligonucleotide
  Target: ATXN1; (+) strand; PAM type: NNGRRT; PAM sequence: GGGGAT
acatcattaaaaatggaaaa

SEQ ID NO: 24583 - DNA, 20 bp, Artificial Sequence
  Description of Artificial Sequence: Synthetic oligonucleotide
  Target: ATXN1; (+) strand; PAM type: NNGRRT; PAM sequence: TTGGAT
atgtcaataaatctcacaac

SEQ ID NO: 24584 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aagcataacttaccaatagc

SEQ ID NO: 24585 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aagaataaacagaaaatctg

SEQ ID NO: 24586 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gttggctatatgttaagaaa

SEQ ID NO: 24587 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tctacacatgttaaaatgca

SEQ ID NO: 24588 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tagaattgtacatcaaaaaa

SEQ ID NO: 24589 - DNA, 20 bp, Artificial Sequence
  Description of Artificial Sequence: Synthetic oligonucleotide
  Target: ATXN1; (+) strand; PAM type: NNGRRT; PAM sequence: TGGAAT
caagcccaaagatttcactg

SEQ ID NO: 24590 - DNA, 20 bp, Artificial Sequence
  Description of Artificial Sequence: Synthetic oligonucleotide
  Target: ATXN1; (+) strand; PAM type: NNGRRT; PAM sequence: ACGAAT
gtaaaaaacaggaggactcc

SEQ ID NO: 24591 - DNA, 20 bp, Artificial Sequence
  Description of Artificial Sequence: Synthetic oligonucleotide
  Target: ATXN1; (+) strand; PAM type: NNGRRT; PAM sequence: GAGAAT
acacaaattcttagaaaaaa

SEQ ID NO: 24592 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggttatataaataatttgaa

SEQ ID NO: 24593 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gagaaagatataccgtgttt

SEQ ID NO: 24594 - DNA, 20 bp, Artificial Sequence
  Description of Artificial Sequence: Synthetic oligonucleotide
  Target: ATXN1; (+) strand; PAM type: NNGRRT; PAM sequence: GTGAAT
gaagtttcaatattgttaag

SEQ ID NO: 24595 - DNA, 20 bp, Artificial Sequence
  Description of Artificial Sequence: Synthetic oligonucleotide
  Target: ATXN1; (+) strand; PAM type: NNGRRT; PAM sequence: GGGGGT
acttctaacaggcttttttg

SEQ ID NO: 24596 - DNA, 20 bp, Artificial Sequence
  Description of Artificial Sequence: Synthetic oligonucleotide
  Target: ATXN1; (+) strand; PAM type: NNGRRT; PAM sequence: GGGGAT
caggcttttttggggggtag

SEQ ID NO: 24597 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttaacatttattcattattt

SEQ ID NO: 24598 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tattgttattatttttgaga

SEQ ID NO: 24599 - DNA, 20 bp, Artificial Sequence
  Description of Artificial Sequence: Synthetic oligonucleotide
  Target: ATXN1; (+) strand; PAM type: NNGRRT; PAM sequence: CGGAGT
tccagctcagtcacccaggc

SEQ ID NO: 24600 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ttttgtatttttagtagaga

SEQ ID NO: 24601 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcggcctcccaaagtac

SEQ ID NO: 24602 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cacggtctcactctgctgcc

SEQ ID NO: 24603 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tctcactctgctgcccagga

SEQ ID NO: 24604 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcagcctcccaaggtgc

SEQ ID NO: 24605 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gactgcagatcagtggaaca

SEQ ID NO: 24606 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttcatacattttaataaaaa

SEQ ID NO: 24607 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aatcttccaggagaaaacag

SEQ ID NO: 24608 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ggataacatcttagcaacca

SEQ ID NO: 24609 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gatcctcccacctcagcctc

SEQ ID NO: 24610 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcagcctcctgagtatc

SEQ ID NO: 24611 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttttgtatttttaatagaga

SEQ ID NO: 24612 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ggaagggggcagaggggctc

SEQ ID NO: 24613 - DNA, 20 bp, Artificial Sequence
  Description of Artificial Sequence: Synthetic oligonucleotide
  Target: ATXN1; (+) strand; PAM type: NNGRRT; PAM sequence: TAGGAT
gaaatgtcccatatcttgat

SEQ ID NO: 24614 - DNA, 20 bp, Artificial Sequence
  Description of Artificial Sequence: Synthetic oligonucleotide
  Target: ATXN1; (+) strand; PAM type: NNGRRT; PAM sequence: GTGGAT
ttgattaggatgctgattat

SEQ ID NO: 24615 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aaagatgtactttctacctg

SEQ ID NO: 24616 - DNA, 20 bp, Artificial Sequence
  Description of Artificial Sequence: Synthetic oligonucleotide
  Target: ATXN1; (+) strand; PAM type: NNGRRT; PAM sequence: GGGGAT
tttctacctggagggtctgt

SEQ ID NO: 24617 - DNA, 20 bp, Artificial Sequence
  Description of Artificial Sequence: Synthetic oligonucleotide
  Target: ATXN1; (+) strand; PAM type: NNGRRT; PAM sequence: TTGAGT
caaaggaacagtgaacatgc

SEQ ID NO: 24618 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gagaagagaaatagagaaga

SEQ ID NO: 24619 - DNA, 20 bp, Artificial Sequence
  Description of Artificial Sequence: Synthetic oligonucleotide
  Target: ATXN1; (+) strand; PAM type: NNGRRT; PAM sequence: ACGAGT
tatacaccaaacaggaagac

SEQ ID NO: 24620 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ttggaagctaggggagggaa

SEQ ID NO: 24621 - DNA, 20 bp, Artificial Sequence
  Description of Artificial Sequence: Synthetic oligonucleotide
  Target: ATXN1; (+) strand; PAM type: NNGRRT; PAM sequence: TAGGAT
atagatttatatgtacctgc

SEQ ID NO: 24622 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tctgttcattcccttagtaa

SEQ ID NO: 24623 - DNA, 20 bp, Artificial Sequence
  Description of Artificial Sequence: Synthetic oligonucleotide
  Target: ATXN1; (+) strand; PAM type: NNGRRT; PAM sequence: GGGAGT
aaactcacaaatggctacga

SEQ ID NO: 24624 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aacatttctcctttttccag

SEQ ID NO: 24625 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ttaatgccaactcttcctct

SEQ ID NO: 24626 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tgagtcatcccttccagtga

SEQ ID NO: 24627 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cttccagtgaaagaatcgct

SEQ ID NO: 24628 - DNA, 20 bp, Artificial Sequence
  Description of Artificial Sequence: Synthetic oligonucleotide
  Target: ATXN1; (+) strand; PAM type: NNGRRT; PAM sequence: TGGAGT
cattaaactttaccaaacaa

SEQ ID NO: 24629 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aaacaatggagtggtaaggg

SEQ ID NO: 24630 - DNA, 20 bp, Artificial Sequence
  Description of Artificial Sequence: Synthetic oligonucleotide
  Target: ATXN1; (+) strand; PAM type: NNGRRT; PAM sequence: GAGGGT
gagtggtaagggaagagttg

SEQ ID NO: 24631 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agggtttctgtccaaactat

SEQ ID NO: 24632 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gaatctagagggaccgctcc

SEQ ID NO: 24633 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tctatttcaatttacaaacg

SEQ ID NO: 24634 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tttacaaacgctgggtttac

SEQ ID NO: 24635 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctataaaattagcttactca

SEQ ID NO: 24636 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gtgtgaaaactgctcaatcc

SEQ ID NO: 24637 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ccaaatattccagacaggga

SEQ ID NO: 24638 - DNA, 20 bp, Artificial Sequence
  Description of Artificial Sequence: Synthetic oligonucleotide
  Target: ATXN1; (+) strand; PAM type: NNGRRT; PAM sequence: TAGAGT
ggaaagaatctgagaaaaca

SEQ ID NO: 24639 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gaatctgagaaaacatagag

SEQ ID NO: 24640 - DNA, 20 bp, Artificial Sequence
  Description of Artificial Sequence: Synthetic oligonucleotide
  Target: ATXN1; (+) strand; PAM type: NNGRRT; PAM sequence: CTGGAT
ggagcaaatataaaatccaa

SEQ ID NO: 24641 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cagcagcatcagtttcacgg

SEQ ID NO: 24642 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cagtactttgggaggccaaa

SEQ ID NO: 24643 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccaaagcgg

SEQ ID NO: 24644 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctacttgggaggttgaggca

SEQ ID NO: 24645 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctccatgccagcctgggcga

SEQ ID NO: 24646 - DNA, 20 bp, Artificial Sequence
  Description of Artificial Sequence: Synthetic oligonucleotide
  Target: ATXN1; (+) strand; PAM type: NNGRRT; PAM sequence: AAGGAT
gaacagctacccaaaaagac

SEQ ID NO: 24647 - DNA, 20 bp, Artificial Sequence
  Description of Artificial Sequence: Synthetic oligonucleotide
  Target: ATXN1; (+) strand; PAM type: NNGRRT; PAM sequence: ATGGGT
attcctttgaaagctctgtg

SEQ ID NO: 24648 - DNA, 20 bp, Artificial Sequence
  Description of Artificial Sequence: Synthetic oligonucleotide
  Target: ATXN1; (+) strand; PAM type: NNGRRT; PAM sequence: GTGAAT
atttttaaaatttactcaag

SEQ ID NO: 24649 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ttcttatccagatcaattcc

SEQ ID NO: 24650 - DNA, 20 bp, Artificial Sequence
  Description of Artificial Sequence: Synthetic oligonucleotide
  Target: ATXN1; (+) strand; PAM type: NNGRRT; PAM sequence: TGGAAT
attccaggagttacggggcg

SEQ ID NO: 24651 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctgttgctttgggcatgaaa

SEQ ID NO: 24652 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ctggccccattatttctcac

SEQ ID NO: 24653 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttttgaactcatcgtccaca

SEQ ID NO: 24654 - DNA, 20 bp, Artificial Sequence
  Description of Artificial Sequence: Synthetic oligonucleotide
  Target: ATXN1; (+) strand; PAM type: NNGRRT; PAM sequence: ATGAGT
acaatagcttctatttaaac

SEQ ID NO: 24655 - DNA, 20 bp, Artificial Sequence
  Description of Artificial Sequence: Synthetic oligonucleotide
  Target: ATXN1; (+) strand; PAM type: NNGRRT; PAM sequence: GTGAAT
actatgaacttagtaacgct

SEQ ID NO: 24656 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgaacttagtaacgctgtga

SEQ ID NO: 24657 - DNA, 20 bp, Artificial Sequence
  Description of Artificial Sequence: Synthetic oligonucleotide
  Target: ATXN1; (+) strand; PAM type: NNGRRT; PAM sequence: ATGAAT
agaccatgctttgtgttggt

SEQ ID NO: 24658 - DNA, 20 bp, Artificial Sequence
  Description of Artificial Sequence: Synthetic oligonucleotide
  Target: ATXN1; (+) strand; PAM type: NNGRRT; PAM sequence: TGGAAT
atgtggtctcccatatgttt

SEQ ID NO: 24659 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tctacagattagaaaacccc

SEQ ID NO: 24660 - DNA, 20 bp, Artificial Sequence
  Description of Artificial Sequence: Synthetic oligonucleotide
  Target: ATXN1; (+) strand; PAM type: NNGRRT; PAM sequence: CTGGAT
agacaagcattcccaaatta

SEQ ID NO: 24661 - DNA, 20 bp, Artificial Sequence
  Description of Artificial Sequence: Synthetic oligonucleotide
  Target: ATXN1; (+) strand; PAM type: NNGRRT; PAM sequence: AGGGAT
catccaaacttcccaagggc

SEQ ID NO: 24662 - DNA, 20 bp, Artificial Sequence
  Description of Artificial Sequence: Synthetic oligonucleotide
  Target: ATXN1; (+) strand; PAM type: NNGRRT; PAM sequence: ATGAGT
actgtttgtaagattaataa

SEQ ID NO: 24663 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tctgatcttctgtttgttca

SEQ ID NO: 24664 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gtttgttcactgaattgtgg

SEQ ID NO: 24665 - DNA, 20 bp, Artificial Sequence
  Description of Artificial Sequence: Synthetic oligonucleotide
  Target: ATXN1; (+) strand; PAM type: NNGRRT; PAM sequence: GGGGGT
ctgaattgtggcagggttgt

SEQ ID NO: 24666 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gttggcaaacattttctgat

SEQ ID NO: 24667 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tatagacattagacaaatta

SEQ ID NO: 24668 - DNA, 20 bp, Artificial Sequence
  Description of Artificial Sequence: Synthetic oligonucleotide
  Target: ATXN1; (+) strand; PAM type: NNGRRT; PAM sequence: CTGGAT
actttatttacaagaacagg

SEQ ID NO: 24669 - DNA, 20 bp, Artificial Sequence
  Description of Artificial Sequence: Synthetic oligonucleotide
  Target: ATXN1; (+) strand; PAM type: NNGRRT; PAM sequence: CTGGAT
atagtttgcctactcctggt

SEQ ID NO: 24670 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tttgcctactcctggtctgg

SEQ ID NO: 24671 - DNA, 20 bp, Artificial Sequence
  Description of Artificial Sequence: Synthetic oligonucleotide
  Target: ATXN1; (+) strand; PAM type: NNGRRT; PAM sequence: GTGGAT
tatagtaagaacaaaattta

SEQ ID NO: 24672 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gcacctgatgaaatatagtc

SEQ ID NO: 24673 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctggcttagccaggaaagta

SEQ ID NO: 24674 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gcaatgccaaggttgttggg

SEQ ID NO: 24675 - DNA, 20 bp, Artificial Sequence
  Description of Artificial Sequence: Synthetic oligonucleotide
  Target: ATXN1; (+) strand; PAM type: NNGRRT; PAM sequence: GGGAGT
accctagtgagatgactgta

SEQ ID NO: 24676 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aagcaaacacctgactccat

SEQ ID NO: 24677 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tcaataaagtagcttccagt

SEQ ID NO: 24678 - DNA, 20 bp, Artificial Sequence
  Description of Artificial Sequence: Synthetic oligonucleotide
  Target: ATXN1; (+) strand; PAM type: NNGRRT; PAM sequence: GAGAAT
catgcagcttaacacagaga

SEQ ID NO: 24679 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gtgctcatcatgtgggcctt

SEQ ID NO: 24680 - DNA, 20 bp, Artificial Sequence
  Description of Artificial Sequence: Synthetic oligonucleotide
  Target: ATXN1; (+) strand; PAM type: NNGRRT; PAM sequence: GCGGAT
tgttagtaatggtttccact

SEQ ID NO: 24681 - DNA, 20 bp, Artificial Sequence
  Description of Artificial Sequence: Synthetic oligonucleotide
  Target: ATXN1; (+) strand; PAM type: NNGRRT; PAM sequence: GTGGGT
cattctggcataacgatctc

SEQ ID NO: 24682 - DNA, 20 bp, Artificial Sequence
  Description of Artificial Sequence: Synthetic oligonucleotide
  Target: ATXN1; (+) strand; PAM type: NNGRRT; PAM sequence: GAGGAT
cataacgatctcgtgggtct

SEQ ID NO: 24683 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ctcatctgtggcatagctct

SEQ ID NO: 24684 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ctgattttcacagagctgtt

SEQ ID NO: 24685 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tttgcttccctatacatgta

SEQ ID NO: 24686 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cagtaccaattagtgactgg

SEQ ID NO: 24687 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aaaaaatctaaatcatagtg

SEQ ID NO: 24688 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ttagccacaaaaatatgaca

SEQ ID NO: 24689 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctgttttgcctaaatcttgc

SEQ ID NO: 24690 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaactaactgcaacggagc

SEQ ID NO: 24691 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tatacccacagaagaaccaa

SEQ ID NO: 24692 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gtttcgctggaaatgctgtg

SEQ ID NO: 24693 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ttgagttacaccatccaact

SEQ ID NO: 24694 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tggagaccatctgaactgcc

SEQ ID NO: 24695 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tttgttcataggtttttact

SEQ ID NO: 24696 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ttttactgggaattttcaca

SEQ ID NO: 24697 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tttatttcccataacatttg

SEQ ID NO: 24698 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gagcacttaataaacatttg

SEQ ID NO: 24699 - DNA, 20 bp, Artificial Sequence
  Description of Artificial Sequence: Synthetic oligonucleotide
  Target: ATXN1; (+) strand; PAM type: NNGRRT; PAM sequence: GTGAAT
agagaaatctggcctttcac

SEQ ID NO: 24700 - DNA, 20 bp, Artificial Sequence
  Description of Artificial Sequence: Synthetic oligonucleotide
  Target: ATXN1; (+) strand; PAM type: NNGRRT; PAM sequence: AAGGAT
acatcaaaaattctccaggg

SEQ ID NO: 24701 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gcaaattgatagatcacctt

SEQ ID NO: 24702 - DNA, 20 bp, Artificial Sequence
  Description of Artificial Sequence: Synthetic oligonucleotide
  Target: ATXN1; (+) strand; PAM type: NNGRRT; PAM sequence: ACGAAT
ttggtgcattaaaattaaaa

SEQ ID NO: 24703 - DNA, 20 bp, Artificial Sequence
  Description of Artificial Sequence: Synthetic oligonucleotide
  Target: ATXN1; (+) strand; PAM type: NNGRRT; PAM sequence: GCGAAT
acaactagaaaaacccgaca

SEQ ID NO: 24704 - DNA, 20 bp, Artificial Sequence
  Description of Artificial Sequence: Synthetic oligonucleotide
  Target: ATXN1; (+) strand; PAM type: NNGRRT; PAM sequence: TAGAAT
ccagtcagggctatagggct

SEQ ID NO: 24705 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tgaaagattaaagaggaaac

SEQ ID NO: 24706 - DNA, 20 bp, Artificial Sequence
  Description of Artificial Sequence: Synthetic oligonucleotide
  Target: ATXN1; (+) strand; PAM type: NNGRRT; PAM sequence: CCGGAT
tgacagctgagataggctct

SEQ ID NO: 24707 - DNA, 20 bp, Artificial Sequence
  Description of Artificial Sequence: Synthetic oligonucleotide
  Target: ATXN1; (+) strand; PAM type: NNGRRT; PAM sequence: ATGGAT
cagcccctgacataaatgtc

SEQ ID NO: 24708 - DNA, 20 bp, Artificial Sequence
  Description of Artificial Sequence: Synthetic oligonucleotide
  Target: ATXN1; (+) strand; PAM type: NNGRRT; PAM sequence: CCGGGT
acataaatgtcatggatttc

SEQ ID NO: 24709 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aaatgtcatggatttcccgg

SEQ ID NO: 24710 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gtgaaaacagaggcagagac

SEQ ID NO: 24711 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aggaacgcctggaaccacca

SEQ ID NO: 24712 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ctcccaacagagcttcggga

SEQ ID NO: 24713 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gagcagccctggaaaactaa

SEQ ID NO: 24714 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tccctgactccaccaaacaa

SEQ ID NO: 24715 - DNA, 20 bp, Artificial Sequence
  Description of Artificial Sequence: Synthetic oligonucleotide
  Target: ATXN1; (+) strand; PAM type: NNGRRT; PAM sequence: GGGGGT
acatatcctactctattttg

SEQ ID NO: 24716 - DNA, 20 bp, Artificial Sequence
  Description of Artificial Sequence: Synthetic oligonucleotide
  Target: ATXN1; (+) strand; PAM type: NNGRRT; PAM sequence: TAGAGT
tattttggggggtctgcaaa

SEQ ID NO: 24717 - DNA, 20 bp, Artificial Sequence
  Description of Artificial Sequence: Synthetic oligonucleotide
  Target: ATXN1; (+) strand; PAM type: NNGRRT; PAM sequence: AAGAAT
caataaatacttggttgtat

SEQ ID NO: 24718 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaatacttggttgtataaga

SEQ ID NO: 24719 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cattctctgcattgcaagtc

SEQ ID NO: 24720 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tattatttttgaaaatatct

SEQ ID NO: 24721 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ggcttttttgcttttattat

SEQ ID NO: 24722 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ttcctaccagctatgtgagc

SEQ ID NO: 24723 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ccctctttgagcctgtagaa

SEQ ID NO: 24724 - DNA, 20 bp, Artificial Sequence
  Description of Artificial Sequence: Synthetic oligonucleotide
  Target: ATXN1; (+) strand; PAM type: NNGRRT; PAM sequence: TGGAAT
caagacttgtgcagatgtaa

SEQ ID NO: 24725 - DNA, 20 bp, Artificial Sequence
  Description of Artificial Sequence: Synthetic oligonucleotide
  Target: ATXN1; (+) strand; PAM type: NNGRRT; PAM sequence: GAGGAT
atttgtgcttgacacaccca

SEQ ID NO: 24726 - DNA, 20 bp, Artificial Sequence
  Description of Artificial Sequence: Synthetic oligonucleotide
  Target: ATXN1; (+) strand; PAM type: NNGRRT; PAM sequence: GTGGAT
gcatgtagccatcccaaaat

SEQ ID NO: 24727 - DNA, 20 bp, Artificial Sequence
  Description of Artificial Sequence: Synthetic oligonucleotide
  Target: ATXN1; (+) strand; PAM type: NNGRRT; PAM sequence: GGGGGT
gaaatatgtaccaagtggct

SEQ ID NO: 24728 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gggaggactgcttgaggcca

SEQ ID NO: 24729 - DNA, 20 bp, Artificial Sequence
  Description of Artificial Sequence: Synthetic oligonucleotide
  Target: ATXN1; (+) strand; PAM type: NNGRRT; PAM sequence: CCGGGT
aacaagaggactgcttgagc

SEQ ID NO: 24730 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tcatgccactgcactccagc

SEQ ID NO: 24731 - DNA, 20 bp, Artificial Sequence
  Description of Artificial Sequence: Synthetic oligonucleotide
  Target: ATXN1; (+) strand; PAM type: NNGRRT; PAM sequence: TTGAAT
catgtcatggttatttttaa

SEQ ID NO: 24732 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cctatgaaccttttgagaaa

SEQ ID NO: 24733 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tttgagaaacagaattcttg

SEQ ID NO: 24734 - DNA, 20 bp, Artificial Sequence
  Description of Artificial Sequence: Synthetic oligonucleotide
  Target: ATXN1; (+) strand; PAM type: NNGRRT; PAM sequence: CAGAAT
cccagaaaaacccacataca

SEQ ID NO: 24735 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aagttcagtgatcagaaatg

SEQ ID NO: 24736 - DNA, 20 bp, Artificial Sequence
  Description of Artificial Sequence: Synthetic oligonucleotide
  Target: ATXN1; (+) strand; PAM type: NNGRRT; PAM sequence: ACGAGT
tgaggaaatgaaaggagata

SEQ ID NO: 24737 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gggcccaaagttcagcaaat

SEQ ID NO: 24738 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tatgtcaaattataaagtct

SEQ ID NO: 24739 - DNA, 20 bp, Artificial Sequence
  Description of Artificial Sequence: Synthetic oligonucleotide
  Target: ATXN1; (+) strand; PAM type: NNGRRT; PAM sequence: CTGAGT
agtcatgatagtaatcaaac

SEQ ID NO: 24740 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gtagttactcaggttcttta

SEQ ID NO: 24741 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ctgttgctttccccatggct

SEQ ID NO: 24742 - DNA, 20 bp, Artificial Sequence
  Description of Artificial Sequence: Synthetic oligonucleotide
  Target: ATXN1; (+) strand; PAM type: NNGRRT; PAM sequence: GCGAGT
gaatgcagtgtcagtaacat

SEQ ID NO: 24743 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tcaaaagatctgttatgttt

SEQ ID NO: 24744 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ggtgtttttacccaacaact

SEQ ID NO: 24745 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cagacttctcagaaataaag

SEQ ID NO: 24746 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aaataaaggagaattctact

SEQ ID NO: 24747 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gagatcattccttccagaga

SEQ ID NO: 24748 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tctatccttctgcagttgaa

SEQ ID NO: 24749 - DNA, 20 bp, Artificial Sequence
  Description of Artificial Sequence: Synthetic oligonucleotide
  Target: ATXN1; (+) strand; PAM type: NNGRRT; PAM sequence: TTGGAT
tcatgttctatatcacccct

SEQ ID NO: 24750 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tttggataaaccttttattt

SEQ ID NO: 24751 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gacaaattccctgcattcaa

SEQ ID NO: 24752 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agaaggaaatttaaattaca

SEQ ID NO: 24753 - DNA, 20 bp, Artificial Sequence
  Description of Artificial Sequence: Synthetic oligonucleotide
  Target: ATXN1; (+) strand; PAM type: NNGRRT; PAM sequence: CCGAGT
atacttcattgtcttaaacc

SEQ ID NO: 24754 - DNA, 20 bp, Artificial Sequence
  Description of Artificial Sequence: Synthetic oligonucleotide
  Target: ATXN1; (+) strand; PAM type: NNGRRT; PAM sequence: ATGAAT
actggcaccagtccttcagt

SEQ ID NO: 24755 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaattcatgaagtctccaa

SEQ ID NO: 24756 - DNA, 20 bp, Artificial Sequence
  Description of Artificial Sequence: Synthetic oligonucleotide
  Target: ATXN1; (+) strand; PAM type: NNGRRT; PAM sequence: AGGAAT
taggtgtctttttgatgagc

SEQ ID NO: 24757 - DNA, 20 bp, Artificial Sequence
  Description of Artificial Sequence: Synthetic oligonucleotide
  Target: ATXN1; (+) strand; PAM type: NNGRRT; PAM sequence: TGGAGT
atgtatggtcatggaagagc

SEQ ID NO: 24758 - DNA, 20 bp, Artificial Sequence
  Description of Artificial Sequence: Synthetic oligonucleotide
  Target: ATXN1; (+) strand; PAM type: NNGRRT; PAM sequence: CAGGGT
cagggcaagcaacccatgaa

SEQ ID NO: 24759 - DNA, 20 bp, Artificial Sequence
  Description of Artificial Sequence: Synthetic oligonucleotide
  Target: ATXN1; (+) strand; PAM type: NNGRRT; PAM sequence: CCGAGT
tacgggacaaccattcagac

SEQ ID NO: 24760 - DNA, 20 bp, Artificial Sequence
  Description of Artificial Sequence: Synthetic oligonucleotide
  Target: ATXN1; (+) strand; PAM type: NNGRRT; PAM sequence: AGGAAT
cttacttgctaaagaacctg

SEQ ID NO: 24761 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tgacgccttaatttttatta

SEQ ID NO: 24762 - DNA, 20 bp, Artificial Sequence
  Description of Artificial Sequence: Synthetic oligonucleotide
  Target: ATXN1; (+) strand; PAM type: NNGRRT; PAM sequence: TAGAGT
agtgtttggtaaagctgata

SEQ ID NO: 24763 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gtcaggtttgattgctgata

SEQ ID NO: 24764 - DNA, 20 bp, Artificial Sequence
  Description of Artificial Sequence: Synthetic oligonucleotide
  Target: ATXN1; (+) strand; PAM type: NNGRRT; PAM sequence: CTGGAT
tataatttgacatattttat

SEQ ID NO: 24765 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tttttcctgttattttggta

SEQ ID NO: 24766 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gcacctagtcttagggctgt

SEQ ID NO: 24767 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gtggagaagtccaggctaac

SEQ ID NO: 24768 - DNA, 20 bp, Artificial Sequence
  Description of Artificial Sequence: Synthetic oligonucleotide
  Target: ATXN1; (+) strand; PAM type: NNGRRT; PAM sequence: AAGAAT
taaccgtttattaagttttg

SEQ ID NO: 24769 - DNA, 20 bp, Artificial Sequence
  Description of Artificial Sequence: Synthetic oligonucleotide
  Target: ATXN1; (+) strand; PAM type: NNGRRT; PAM sequence: CTGAGT
agccttcttaagtacgagag

SEQ ID NO: 24770 - DNA, 20 bp, Artificial Sequence
  Description of Artificial Sequence: Synthetic oligonucleotide
  Target: ATXN1; (+) strand; PAM type: NNGRRT; PAM sequence: AGGAGT
actgcgtgttttcattccag

SEQ ID NO: 24771 - DNA, 20 bp, Artificial Sequence
  Description of Artificial Sequence: Synthetic oligonucleotide
  Target: ATXN1; (+) strand; PAM type: NNGRRT; PAM sequence: GCGAGT
gtgattgttaatttgttatt

SEQ ID NO: 24772 - DNA, 20 bp, Artificial Sequence
  Description of Artificial Sequence: Synthetic oligonucleotide
  Target: ATXN1; (+) strand; PAM type: NNGRRT; PAM sequence: AGGAGT
ttgttattgcgagttcctta

SEQ ID NO: 24773 - DNA, 20 bp, Artificial Sequence
  Description of Artificial Sequence: Synthetic oligonucleotide
  Target: ATXN1; (+) strand; PAM type: NNGRRT; PAM sequence: GGGGAT
gactcactgctaaagacatg

SEQ ID NO: 24774 - DNA, 20 bp, Artificial Sequence
  Description of Artificial Sequence: Synthetic oligonucleotide
  Target: ATXN1; (+) strand; PAM type: NNGRRT; PAM sequence: CAGGGT
aaacactctcccattcaatt

SEQ ID NO: 24775 - DNA, 20 bp, Artificial Sequence
  Description of Artificial Sequence: Synthetic oligonucleotide
  Target: ATXN1; (+) strand; PAM type: NNGRRT; PAM sequence: TTGAAT
aaaagagctaaatccagttt

SEQ ID NO: 24776 - DNA, 20 bp, Artificial Sequence
  Description of Artificial Sequence: Synthetic oligonucleotide
  Target: ATXN1; (+) strand; PAM type: NNGRRT; PAM sequence: CCGAAT
tccagtttttgaatcagaaa

SEQ ID NO: 24777 - DNA, 20 bp, Artificial Sequence
  Description of Artificial Sequence: Synthetic oligonucleotide
  Target: ATXN1; (+) strand; PAM type: NNGRRT; PAM sequence: GAGAAT
atttatgcccagataaggga

SEQ ID NO: 24778 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ccctgtgaactgtaagaggg

SEQ ID NO: 24779 - DNA, 20 bp, Artificial Sequence
  Description of Artificial Sequence: Synthetic oligonucleotide
  Target: ATXN1; (+) strand; PAM type: NNGRRT; PAM sequence: GCGGAT
actttgggaggccaaggcag

SEQ ID NO: 24780 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggcggatcacctgaggtc

SEQ ID NO: 24781 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacacaggtggctgaggcaa

SEQ ID NO: 24782 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ccgggggagcagaggctgca

SEQ ID NO: 24783 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttgcatcactgcactccagt

SEQ ID NO: 24784 - DNA, 20 bp, Artificial Sequence
  Description of Artificial Sequence: Synthetic oligonucleotide
  Target: ATXN1; (+) strand; PAM type: NNGRRT; PAM sequence: AAGGGT
aaaaaaaaaaaaaaaaaggg

SEQ ID NO: 24785 - DNA, 20 bp, Artificial Sequence
  Description of Artificial Sequence: Synthetic oligonucleotide
  Target: ATXN1; (+) strand; PAM type: NNGRRT; PAM sequence: TAGAAT
gcacccaattatgtatgaca

SEQ ID NO: 24786 - DNA, 20 bp, Artificial Sequence
  Description of Artificial Sequence: Synthetic oligonucleotide
  Target: ATXN1; (+) strand; PAM type: NNGRRT; PAM sequence: GCGGGT
cagcactttgggaggccgag

SEQ ID NO: 24787 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccgaggcgg

SEQ ID NO: 24788 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cgggtggatcacttgaggtc

SEQ ID NO: 24789 - DNA, 20 bp, Artificial Sequence
  Description of Artificial Sequence: Synthetic oligonucleotide
  Target: ATXN1; (+) strand; PAM type: NNGRRT; PAM sequence: CTGGGT
actaaaaagacaaaaaacag

SEQ ID NO: 24790 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tactcaggaggctgaggcag

SEQ ID NO: 24791 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cttcatctcaaaaaaaaaca

SEQ ID NO: 24792 - DNA, 20 bp, Artificial Sequence
  Description of Artificial Sequence: Synthetic oligonucleotide
  Target: ATXN1; (+) strand; PAM type: NNGRRT; PAM sequence: CAGGGT
aacaaagaataatttcttaa

SEQ ID NO: 24793 - DNA, 20 bp, Artificial Sequence
  Description of Artificial Sequence: Synthetic oligonucleotide
  Target: ATXN1; (+) strand; PAM type: NNGRRT; PAM sequence: ATGGAT
ttaacagggtcctacttcag

SEQ ID NO: 24794 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctacttcagatggattgctc

SEQ ID NO: 24795 - DNA, 20 bp, Artificial Sequence
  Description of Artificial Sequence: Synthetic oligonucleotide
  Target: ATXN1; (+) strand; PAM type: NNGRRT; PAM sequence: TGGAGT
gctcaagagttcaggccata

SEQ ID NO: 24796 - DNA, 20 bp, Artificial Sequence
  Description of Artificial Sequence: Synthetic oligonucleotide
  Target: ATXN1; (+) strand; PAM type: NNGRRT; PAM sequence: CTGGAT
gacactgaacatactacttt

SEQ ID NO: 24797 - DNA, 20 bp, Artificial Sequence
  Description of Artificial Sequence: Synthetic oligonucleotide
  Target: ATXN1; (+) strand; PAM type: NNGRRT; PAM sequence: TTGGAT
taataaaaaagcaattaatt

SEQ ID NO: 24798 - DNA, 20 bp, Artificial Sequence
  Description of Artificial Sequence: Synthetic oligonucleotide
  Target: ATXN1; (+) strand; PAM type: NNGRRT; PAM sequence: ATGAAT
gctcagagaagacatctaat

SEQ ID NO: 24799 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aatgatcatcaaattactta

SEQ ID NO: 24800 - DNA, 20 bp, Artificial Sequence
  Description of Artificial Sequence: Synthetic oligonucleotide
  Target: ATXN1; (+) strand; PAM type: NNGRRT; PAM sequence: GAGGAT
attttgcatgaggaggctgt

SEQ ID NO: 24801 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gattaaacgcctggagcatg

SEQ ID NO: 24802 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ggcaaaggcctccagtcaca

SEQ ID NO: 24803 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gctgggcatggacagtgggg

SEQ ID NO: 24804 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tgggaaccctcacagcaaag

SEQ ID NO: 24805 - DNA, 20 bp, Artificial Sequence
  Description of Artificial Sequence: Synthetic oligonucleotide
  Target: ATXN1; (+) strand; PAM type: NNGRRT; PAM sequence: CAGGAT
gcagggtggtcagaaacaaa

SEQ ID NO: 24806 - DNA, 20 bp, Artificial Sequence
  Description of Artificial Sequence: Synthetic oligonucleotide
  Target: ATXN1; (+) strand; PAM type: NNGRRT; PAM sequence: TGGGAT
ggatatgtatgggcaacatc

SEQ ID NO: 24807 - DNA, 20 bp, Artificial Sequence
  Description of Artificial Sequence: Synthetic oligonucleotide
  Target: ATXN1; (+) strand; PAM type: NNGRRT; PAM sequence: GAGAAT
taagttagaaaactccaaag

SEQ ID NO: 24808 - DNA, 20 bp, Artificial Sequence
  Description of Artificial Sequence: Synthetic oligonucleotide
  Target: ATXN1; (+) strand; PAM type: NNGRRT; PAM sequence: GTGAAT
atcatcatagcaggtgaagt

SEQ ID NO: 24809 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gcaggtgaagtgtgaatact

SEQ ID NO: 24810 - DNA, 20 bp, Artificial Sequence
  Description of Artificial Sequence: Synthetic oligonucleotide
  Target: ATXN1; (+) strand; PAM type: NNGRRT; PAM sequence: GTGGAT
aggcacaaccttcaccaagt

SEQ ID NO: 24811 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tctatttattcctagttact

SEQ ID NO: 24812 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tcctgaaacaagtcttccta

SEQ ID NO: 24813 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgcctgcctctctggcaact

SEQ ID NO: 24814 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tgcctctctggcaactgaga

SEQ ID NO: 24815 - DNA, 20 bp, Artificial Sequence
  Description of Artificial Sequence: Synthetic oligonucleotide
  Target: ATXN1; (+) strand; PAM type: NNGRRT; PAM sequence: CAGGAT
aagtttgttattggcagaac

SEQ ID NO: 24816 - DNA, 20 bp, Artificial Sequence
  Description of Artificial Sequence: Synthetic oligonucleotide
  Target: ATXN1; (+) strand; PAM type: NNGRRT; PAM sequence: TGGGGT
cttcaaaaggagctttcctg

SEQ ID NO: 24817 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tcctgtggggtgagcggtaa

SEQ ID NO: 24818 - DNA, 20 bp, Artificial Sequence
  Description of Artificial Sequence: Synthetic oligonucleotide
  Target: ATXN1; (+) strand; PAM type: NNGRRT; PAM sequence: ATGAGT
actgagagagcaaagagaaa

SEQ ID NO: 24819 - DNA, 20 bp, Artificial Sequence
  Description of Artificial Sequence: Synthetic oligonucleotide
  Target: ATXN1; (+) strand; PAM type: NNGRRT; PAM sequence: ATGGAT
gagcaaagagaaaatgagtc

SEQ ID NO: 24820 - DNA, 20 bp, Artificial Sequence
  Description of Artificial Sequence: Synthetic oligonucleotide
  Target: ATXN1; (+) strand; PAM type: NNGRRT; PAM sequence: CGGAGT
tgaaactgcatctgggactc

SEQ ID NO: 24821 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tgggactccggagtcaagct

SEQ ID NO: 24822 - DNA, 20 bp, Artificial Sequence
  Description of Artificial Sequence: Synthetic oligonucleotide
  Target: ATXN1; (+) strand; PAM type: NNGRRT; PAM sequence: TCGAAT
caaagcctgtattctttcgt

SEQ ID NO: 24823 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tccaaccctcatggaggtct

SEQ ID NO: 24824 - DNA, 20 bp, Artificial Sequence
  Description of Artificial Sequence: Synthetic oligonucleotide
  Target: ATXN1; (+) strand; PAM type: NNGRRT; PAM sequence: TTGGGT
acagcccacactatgatgct

SEQ ID NO: 24825 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aacggttatatttttgttct

SEQ ID NO: 24826 - DNA, 20 bp, Artificial Sequence
  Description of Artificial Sequence: Synthetic oligonucleotide
  Target: ATXN1; (+) strand; PAM type: NNGRRT; PAM sequence: TAGGGT
ccctctgaacatcagtcacg

SEQ ID NO: 24827 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ctttcttcctttttccccaa

SEQ ID NO: 24828 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggcagatcacttgaggtc

SEQ ID NO: 24829 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactcaggaggctggggcag

SEQ ID NO: 24830 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttgcaccccagcctgggcaa

SEQ ID NO: 24831 - DNA, 20 bp, Artificial Sequence
  Description of Artificial Sequence: Synthetic oligonucleotide
  Target: ATXN1; (+) strand; PAM type: NNGRRT; PAM sequence: GTGAGT
accccagcctgggcaacaga

SEQ ID NO: 24832 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aatggaaatgaacaataact

SEQ ID NO: 24833 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tgtgtgaacgcaaagctttc

SEQ ID NO: 24834 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cgcaaagctttctggagtta

SEQ ID NO: 24835 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttaattctacaaaatacaga

SEQ ID NO: 24836 - DNA, 20 bp, Artificial Sequence
  Description of Artificial Sequence: Synthetic oligonucleotide
  Target: ATXN1; (+) strand; PAM type: NNGRRT; PAM sequence: AGGAAT
catgtgtaccaagacttttt

SEQ ID NO: 24837 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aaatacagaccttcctcttg

SEQ ID NO: 24838 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ccttcctcttgctgagtgtt

SEQ ID NO: 24839 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ctgggtgccgggccatgctg

SEQ ID NO: 24840 - DNA, 20 bp, Artificial Sequence
  Description of Artificial Sequence: Synthetic oligonucleotide
  Target: ATXN1; (+) strand; PAM type: NNGRRT; PAM sequence: CTGAAT
atttttccctttaagtgcaa

SEQ ID NO: 24841 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ccgtattaacagagccaggg

SEQ ID NO: 24842 - DNA, 20 bp, Artificial Sequence
  Description of Artificial Sequence: Synthetic oligonucleotide
  Target: ATXN1; (+) strand; PAM type: NNGRRT; PAM sequence: GGGAGT
aagaatgaaaagaagattct

SEQ ID NO: 24843 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gcaatgagaaatgagggcat

SEQ ID NO: 24844 - DNA, 20 bp, Artificial Sequence
  Description of Artificial Sequence: Synthetic oligonucleotide
  Target: ATXN1; (+) strand; PAM type: NNGRRT; PAM sequence: AAGAAT
actggcattctctgtggtca

SEQ ID NO: 24845 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gctgtcacagaaaagtactt

SEQ ID NO: 24846 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tactgcttggtgttacaggc

SEQ ID NO: 24847 - DNA, 20 bp, Artificial Sequence
  Description of Artificial Sequence: Synthetic oligonucleotide
  Target: ATXN1; (+) strand; PAM type: NNGRRT; PAM sequence: CCGGGT
attggaaaatatcactccgg

SEQ ID NO: 24848 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttaggaggccgaggcag

SEQ ID NO: 24849 - DNA, 20 bp, Artificial Sequence
  Description of Artificial Sequence: Synthetic oligonucleotide
  Target: ATXN1; (+) strand; PAM type: NNGRRT; PAM sequence: AGGAGT
caggtggatcacttgaggtc

SEQ ID NO: 24850 - DNA, 20 bp, Artificial Sequence
  Description of Artificial Sequence: Synthetic oligonucleotide
  Target: ATXN1; (+) strand; PAM type: NNGRRT; PAM sequence: ATGGGT
aaaattaaccaggcgtgcta

SEQ ID NO: 24851 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tactttggaggctgaggcag

SEQ ID NO: 24852 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tggcaccactccactcaagt

SEQ ID NO: 24853 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctccactcaagtctgggtaa

SEQ ID NO: 24854 - DNA, 20 bp, Artificial Sequence
  Description of Artificial Sequence: Synthetic oligonucleotide
  Target: ATXN1; (+) strand; PAM type: NNGRRT; PAM sequence: AAGAGT
caaatcataatagctgataa

SEQ ID NO: 24855 - DNA, 20 bp, Artificial Sequence
  Description of Artificial Sequence: Synthetic oligonucleotide
  Target: ATXN1; (+) strand; PAM type: NNGRRT; PAM sequence: AAGGGT
cccccaacactagttctata

SEQ ID NO: 24856 - DNA, 20 bp, Artificial Sequence
  Description of Artificial Sequence: Synthetic oligonucleotide
  Target: ATXN1; (+) strand; PAM type: NNGRRT; PAM sequence: CAGAAT
taaattgccacctccatcta

SEQ ID NO: 24857 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atggcccttgaaaaacttcc

SEQ ID NO: 24858 - DNA, 20 bp, Artificial Sequence
  Description of Artificial Sequence: Synthetic oligonucleotide
  Target: ATXN1; (+) strand; PAM type: NNGRRT; PAM sequence: ATGAGT
cccttgaaaaacttccatgg

SEQ ID NO: 24859 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ttacctattttttaaatgta

SEQ ID NO: 24860 - DNA, 20 bp, Artificial Sequence
  Description of Artificial Sequence: Synthetic oligonucleotide
  Target: ATXN1; (+) strand; PAM type: NNGRRT; PAM sequence: AAGAAT
acatattttccaaccgatga

SEQ ID NO: 24861 - DNA, 20 bp, Artificial Sequence
  Description of Artificial Sequence: Synthetic oligonucleotide
  Target: ATXN1; (+) strand; PAM type: NNGRRT; PAM sequence: CTGAGT
ctgccatgccgggacccatt

SEQ ID NO: 24862 - DNA, 20 bp, Artificial Sequence
  Description of Artificial Sequence: Synthetic oligonucleotide
  Target: ATXN1; (+) strand; PAM type: NNGRRT; PAM sequence: GAGGAT
actttgggaggccgaggcgg

SEQ ID NO: 24863 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cgggaggatggcttgaggcc

SEQ ID NO: 24864 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aaaaaaattttaaaaattag

SEQ ID NO: 24865 - DNA, 20 bp, Artificial Sequence
  Description of Artificial Sequence: Synthetic oligonucleotide
  Target: ATXN1; (+) strand; PAM type: NNGRRT; PAM sequence: GAGGAT
taatcgggaggctgaggtag

SEQ ID NO: 24866 - DNA, 20 bp, Artificial Sequence
  Description of Artificial Sequence: Synthetic oligonucleotide
  Target: ATXN1; (+) strand; PAM type: NNGRRT; PAM sequence: AAGGGT
taggaggatcacttgagccc

SEQ ID NO: 24867 - DNA, 20 bp, Artificial Sequence
  Description of Artificial Sequence: Synthetic oligonucleotide
  Target: ATXN1; (+) strand; PAM type: NNGRRT; PAM sequence: GGGAGT
tactttgggaggccgaggtc

SEQ ID NO: 24868 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gactaaaaatacaaaattag

SEQ ID NO: 24869 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tacttgggaggctgaggcag

SEQ ID NO: 24870 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ggctgaggcaggagaatcac

SEQ ID NO: 24871 - DNA, 20 bp, Artificial Sequence
  Description of Artificial Sequence: Synthetic oligonucleotide
  Target: ATXN1; (+) strand; PAM type: NNGRRT; PAM sequence: CTGGGT
aaatgaaaaagaaccactgg

SEQ ID NO: 24872 - DNA, 20 bp, Artificial Sequence
  Description of Artificial Sequence: Synthetic oligonucleotide
  Target: ATXN1; (+) strand; PAM type: NNGRRT; PAM sequence: TGGAGT
aaaaagaaccactggctggg

SEQ ID NO: 24873 - DNA, 20 bp, Artificial Sequence
  Description of Artificial Sequence: Synthetic oligonucleotide
  Target: ATXN1; (+) strand; PAM type: NNGRRT; PAM sequence: GTGGAT
actttgggaggccaaggtag

SEQ ID NO: 24874 - DNA, 20 bp, Artificial Sequence
  Description of Artificial Sequence: Synthetic oligonucleotide
  Target: ATXN1; (+) strand; PAM type: NNGRRT; PAM sequence: AGGAGT
taggtggatttcttgtggtc

SEQ ID NO: 24875 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cactccggaggctgacgcag

SEQ ID NO: 24876 - DNA, 20 bp, Artificial Sequence
  Description of Artificial Sequence: Synthetic oligonucleotide
  Target: ATXN1; (+) strand; PAM type: NNGRRT; PAM sequence: CAGAGT
actccagcctaggcaaccga

SEQ ID NO: 24877 - DNA, 20 bp, Artificial Sequence
  Description of Artificial Sequence: Synthetic oligonucleotide
  Target: ATXN1; (+) strand; PAM type: NNGRRT; PAM sequence: TAGAGT
aaaaaaatgtctatagacta

SEQ ID NO: 24878 - DNA, 20 bp, Artificial Sequence
  Description of Artificial Sequence: Synthetic oligonucleotide
  Target: ATXN1; (+) strand; PAM type: NNGRRT; PAM sequence: GTGAAT
agactatagagttaagattt

SEQ ID NO: 24879 - DNA, 20 bp, Artificial Sequence
  Description of Artificial Sequence: Synthetic oligonucleotide
  Target: ATXN1; (+) strand; PAM type: NNGRRT; PAM sequence: TTGAGT
cttggaagggcatgcctcat

SEQ ID NO: 24880 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaaatattgtcatctcacc

SEQ ID NO: 24881 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggtgcgagaaaagaaggaag

SEQ ID NO: 24882 - DNA, 20 bp, Artificial Sequence
  Description of Artificial Sequence: Synthetic oligonucleotide
  Target: ATXN1; (+) strand; PAM type: NNGRRT; PAM sequence: TGGAGT
atatgtatacttttttgaga

SEQ ID NO: 24883 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcgctcaggc

SEQ ID NO: 24884 - DNA, 20 bp, Artificial Sequence
  Description of Artificial Sequence: Synthetic oligonucleotide
  Target: ATXN1; (+) strand; PAM type: NNGRRT; PAM sequence: CTGAGT
aattctcctgcctcagcctc

SEQ ID NO: 24885 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tttttgtattttagtaaaga

SEQ ID NO: 24886 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gccttggcctctcaaagtgc

SEQ ID NO: 24887 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gtggttccttctgaggtggg

SEQ ID NO: 24888 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gttgatggtaattttaaaat

SEQ ID NO: 24889 - DNA, 20 bp, Artificial Sequence
  Description of Artificial Sequence: Synthetic oligonucleotide
  Target: ATXN1; (+) strand; PAM type: NNGRRT; PAM sequence: TAGAGT
gtaattttaaaatatgggtg

SEQ ID NO: 24890 - DNA, 20 bp, Artificial Sequence
  Description of Artificial Sequence: Synthetic oligonucleotide
  Target: ATXN1; (+) strand; PAM type: NNGRRT; PAM sequence: AGGAGT
aaatatgggtgtagagttaa

SEQ ID NO: 24891 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ttataatttacatttatttt

SEQ ID NO: 24892 - DNA, 20 bp, Artificial Sequence
  Description of Artificial Sequence: Synthetic oligonucleotide
  Target: ATXN1; (+) strand; PAM type: NNGRRT; PAM sequence: TAGAGT
atgacacaggtggtaggcaa

SEQ ID NO: 24893 - DNA, 20 bp, Artificial Sequence
  Description of Artificial Sequence: Synthetic oligonucleotide
  Target: ATXN1; (+) strand; PAM type: NNGRRT; PAM sequence: CAGGGT
agtataattagttaaaagca

SEQ ID NO: 24894 - DNA, 20 bp, Artificial Sequence
  Description of Artificial Sequence: Synthetic oligonucleotide
  Target: ATXN1; (+) strand; PAM type: NNGRRT; PAM sequence: GAGGAT
gacctatgtaggtttactgt

SEQ ID NO: 24895 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tccctgcattgtgggctttt

SEQ ID NO: 24896 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tatttattaacaatgattta

SEQ ID NO: 24897 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgtcactagaagatgcccaa

SEQ ID NO: 24898 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tggtttataagaaaagtgtg

SEQ ID NO: 24899 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ataagaaaagtgtgaagaat

SEQ ID NO: 24900 - DNA, 20 bp, Artificial Sequence
  Description of Artificial Sequence: Synthetic oligonucleotide
  Target: ATXN1; (+) strand; PAM type: NNGRRT; PAM sequence: CGGGGT
agaagaccaaaattctgtct

SEQ ID NO: 24901 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cactcacctgtaggtgtact

SEQ ID NO: 24902 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cctaatatcttacattgaca

SEQ ID NO: 24903 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ataatacaaaaaaagcatca

SEQ ID NO: 24904 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tatagtaggctgagaaaaaa

SEQ ID NO: 24905 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tgagaaaaaatagaattaaa

SEQ ID NO: 24906 - DNA, 20 bp, Artificial Sequence
  Description of Artificial Sequence: Synthetic oligonucleotide
  Target: ATXN1; (+) strand; PAM type: NNGRRT; PAM sequence: ATGAAT
acccttctgatttaaatttc

SEQ ID NO: 24907 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tgatattcatggctaaactc

SEQ ID NO: 24908 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aattttattatcaaagtatt

SEQ ID NO: 24909 - DNA, 20 bp, Artificial Sequence
  Description of Artificial Sequence: Synthetic oligonucleotide
  Target: ATXN1; (+) strand; PAM type: NNGRRT; PAM sequence: TAGAAT
taacacaacagttctcctag

SEQ ID NO: 24910 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cttaaaataaagagcttttc

SEQ ID NO: 24911 - DNA, 20 bp, Artificial Sequence
  Description of Artificial Sequence: Synthetic oligonucleotide
  Target: ATXN1; (+) strand; PAM type: NNGRRT; PAM sequence: GGGAAT
acaaaagaaaaatgctagag

SEQ ID NO: 24912 - DNA, 20 bp, Artificial Sequence
  Description of Artificial Sequence: Synthetic oligonucleotide
  Target: ATXN1; (+) strand; PAM type: NNGRRT; PAM sequence: CTGAAT
agctgtacaattagccaaaa

SEQ ID NO: 24913 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aacaaagggaaatccaattg

SEQ ID NO: 24914 - DNA, 20 bp, Artificial Sequence
  Description of Artificial Sequence: Synthetic oligonucleotide
  Target: ATXN1; (+) strand; PAM type: NNGRRT; PAM sequence: GTGAAT
acgtatatcgcaaagtgttt

SEQ ID NO: 24915 - DNA, 20 bp, Artificial Sequence
  Description of Artificial Sequence: Synthetic oligonucleotide
  Target: ATXN1; (+) strand; PAM type: NNGRRT; PAM sequence: TCGGGT
gaaatagattcatcagcatt

SEQ ID NO: 24916 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ttcacagagactggtaaata

SEQ ID NO: 24917 - DNA, 20 bp, Artificial Sequence
  Description of Artificial Sequence: Synthetic oligonucleotide
  Target: ATXN1; (+) strand; PAM type: NNGRRT; PAM sequence: CTGGAT
agaatgtatgcacaaaacac

SEQ ID NO: 24918 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tcaaacaaaccttcaaagca

SEQ ID NO: 24919 - DNA, 20 bp, Artificial Sequence
  Description of Artificial Sequence: Synthetic oligonucleotide
  Target: ATXN1; (+) strand; PAM type: NNGRRT; PAM sequence: TAGGGT
actgttgcagtttgaagctg

SEQ ID NO: 24920 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ctttagtaagtgatgccaaa

SEQ ID NO: 24921 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ttcagttttgactaggagca

SEQ ID NO: 24922 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ttttgactaggagcagtgaa

SEQ ID NO: 24923 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gaaactccagccataatatt

SEQ ID NO: 24924 - DNA, 20 bp, Artificial Sequence
  Description of Artificial Sequence: Synthetic oligonucleotide
  Target: ATXN1; (+) strand; PAM type: NNGRRT; PAM sequence: TAGAAT
taatattcagaataacacac

SEQ ID NO: 24925 - DNA, 20 bp, Artificial Sequence
  Description of Artificial Sequence: Synthetic oligonucleotide
  Target: ATXN1; (+) strand; PAM type: NNGRRT; PAM sequence: AAGAAT
aaaatagacggcatccagtt

SEQ ID NO: 24926 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ccagttaagaattttgaaag

SEQ ID NO: 24927 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttaatgtacttggaaaacct

SEQ ID NO: 24928 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttggaaaacctcagagtcta

SEQ ID NO: 24929 - DNA, 20 bp, Artificial Sequence
  Description of Artificial Sequence: Synthetic oligonucleotide
  Target: ATXN1; (+) strand; PAM type: NNGRRT; PAM sequence: AGGAGT
acgaagagccaaaatatttc

SEQ ID NO: 24930 - DNA, 20 bp, Artificial Sequence
  Description of Artificial Sequence: Synthetic oligonucleotide
  Target: ATXN1; (+) strand; PAM type: NNGRRT; PAM sequence: GCGAAT
tgctaaaaattacatttgca

SEQ ID NO: 24931 - DNA, 20 bp, Artificial Sequence
  Description of Artificial Sequence: Synthetic oligonucleotide
  Target: ATXN1; (+) strand; PAM type: NNGRRT; PAM sequence: CAGAAT
agcgaatccaggaccaatgc

SEQ ID NO: 24932 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gaccaatgccagaatgatct

SEQ ID NO: 24933 - DNA, 20 bp, Artificial Sequence
  Description of Artificial Sequence: Synthetic oligonucleotide
  Target: ATXN1; (+) strand; PAM type: NNGRRT; PAM sequence: GAGAGT
acacctaatttctccttgag

SEQ ID NO: 24934 - DNA, 20 bp, Artificial Sequence
  Description of Artificial Sequence: Synthetic oligonucleotide
  Target: ATXN1; (+) strand; PAM type: NNGRRT; PAM sequence: GAGAAT
ccttgaggagagtagaaatg

SEQ ID NO: 24935 - DNA, 20 bp, Artificial Sequence
  Description of Artificial Sequence: Synthetic oligonucleotide
  Target: ATXN1; (+) strand; PAM type: NNGRRT; PAM sequence: GTGGGT
agaagggcacatccatattt

SEQ ID NO: 24936 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tccatatttgtgggtaatta

SEQ ID NO: 24937 - DNA, 20 bp, Artificial Sequence
  Description of Artificial Sequence: Synthetic oligonucleotide
  Target: ATXN1; (+) strand; PAM type: NNGRRT; PAM sequence: ATGGGT
caaataggtgaagtatgtgt

SEQ ID NO: 24938 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tgtgtgtattggcaaaagac

SEQ ID NO: 24939 - DNA, 20 bp, Artificial Sequence
  Description of Artificial Sequence: Synthetic oligonucleotide
  Target: ATXN1; (+) strand; PAM type: NNGRRT; PAM sequence: CAGGAT
agactagaattttaaaaaac

SEQ ID NO: 24940 - DNA, 20 bp, Artificial Sequence
  Description of Artificial Sequence: Synthetic oligonucleotide
  Target: ATXN1; (+) strand; PAM type: NNGRRT; PAM sequence: CTGAAT
taaaaaaagcacatctatga

SEQ ID NO: 24941 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tgtaacactagccactgtga

SEQ ID NO: 24942 - DNA, 20 bp, Artificial Sequence
  Description of Artificial Sequence: Synthetic oligonucleotide
  Target: ATXN1; (+) strand; PAM type: NNGRRT; PAM sequence: ATGAAT
accctataagatatgtaaac

SEQ ID NO: 24943 - DNA, 20 bp, Artificial Sequence
  Description of Artificial Sequence: Synthetic oligonucleotide
  Target: ATXN1; (+) strand; PAM type: NNGRRT; PAM sequence: TGGGAT
agaacaagaactgctttctg

SEQ ID NO: 24944 - DNA, 20 bp, Artificial Sequence
  Description of Artificial Sequence: Synthetic oligonucleotide
  Target: ATXN1; (+) strand; PAM type: NNGRRT; PAM sequence: TTGAAT
ttaaatgaaagctattcaac

SEQ ID NO: 24945 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tcctacacaaaaccaatcac

SEQ ID NO: 24946 - DNA, 20 bp, Artificial Sequence
  Description of Artificial Sequence: Synthetic oligonucleotide
  Target: ATXN1; (+) strand; PAM type: NNGRRT; PAM sequence: ATGAAT
cacaaacaagtctgtgcaag

SEQ ID NO: 24947 - DNA, 20 bp, Artificial Sequence
  Description of Artificial Sequence: Synthetic oligonucleotide
  Target: ATXN1; (+) strand; PAM type: NNGRRT; PAM sequence: ATGGAT
aatgccaagatggaaaaaaa

SEQ ID NO: 24948 - DNA, 20 bp, Artificial Sequence
  Description of Artificial Sequence: Synthetic oligonucleotide
  Target: ATXN1; (+) strand; PAM type: NNGRRT; PAM sequence: ATGGGT
ccaagatggaaaaaaaatgg

SEQ ID NO: 24949 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gactccccaagagctcaaga

SEQ ID NO: 24950 - DNA, 20 bp, Artificial Sequence
  Description of Artificial Sequence: Synthetic oligonucleotide
  Target: ATXN1; (+) strand; PAM type: NNGRRT; PAM sequence: AGGGAT
cagctaaaacattgattctc

SEQ ID NO: 24951 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ccaagaggaggtctctgaag

SEQ ID NO: 24952 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tgaagctgggtgtcatcctt

SEQ ID NO: 24953 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tgtcatcctttagggtggcc

SEQ ID NO: 24954 - DNA, 20 bp, Artificial Sequence
  Description of Artificial Sequence: Synthetic oligonucleotide
  Target: ATXN1; (+) strand; PAM type: NNGRRT; PAM sequence: GCGAGT
gtgacacattatgcctcctg

SEQ ID NO: 24955 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ggcttctgtcaagtctaaat

SEQ ID NO: 24956 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gtctaaatgtgaatcagatt

SEQ ID NO: 24957 - DNA, 20 bp, Artificial Sequence
  Description of Artificial Sequence: Synthetic oligonucleotide
  Target: ATXN1; (+) strand; PAM type: NNGRRT; PAM sequence: CAGAAT
accagctccttcttgcctag

SEQ ID NO: 24958 - DNA, 20 bp, Artificial Sequence
  Description of Artificial Sequence: Synthetic oligonucleotide
  Target: ATXN1; (+) strand; PAM type: NNGRRT; PAM sequence: ATGGGT
atgttttcaaccttgctgtc

SEQ ID NO: 24959 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttatttattttttttagaga

SEQ ID NO: 24960 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gccttggcctcccaaagcac

SEQ ID NO: 24961 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tataatgaagcactgtttca

SEQ ID NO: 24962 - DNA, 20 bp, Artificial Sequence
  Description of Artificial Sequence: Synthetic oligonucleotide
  Target: ATXN1; (+) strand; PAM type: NNGRRT; PAM sequence: GGGAAT
cactgtttcaaggggtaact

SEQ ID NO: 24963 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ctgggaattgcacataccca

SEQ ID NO: 24964 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tcggaaacgcaaataatttc

SEQ ID NO: 24965 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ctacatgtatttctaaccac

SEQ ID NO: 24966 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tgttttctcccctagaaaat

SEQ ID NO: 24967 - DNA, 20 bp, Artificial Sequence
  Description of Artificial Sequence: Synthetic oligonucleotide
  Target: ATXN1; (+) strand; PAM type: NNGRRT; PAM sequence: CTGAAT
aacaatttatctaaggcact

SEQ ID NO: 24968 - DNA, 20 bp, Artificial Sequence
  Description of Artificial Sequence: Synthetic oligonucleotide
  Target: ATXN1; (+) strand; PAM type: NNGRRT; PAM sequence: CTGGAT
cattaaccactgcacatggt

SEQ ID NO: 24969 - DNA, 20 bp, Artificial Sequence
  Description of Artificial Sequence: Synthetic oligonucleotide
  Target: ATXN1; (+) strand; PAM type: NNGRRT; PAM sequence: CAGAAT
taaatcagaggctcagactg

SEQ ID NO: 24970 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tgcagaataccatcaagaga

SEQ ID NO: 24971 - DNA, 20 bp, Artificial Sequence
  Description of Artificial Sequence: Synthetic oligonucleotide
  Target: ATXN1; (+) strand; PAM type: NNGRRT; PAM sequence: CCGAAT
aactttgcgatttcaggtca

SEQ ID NO: 24972 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agatgatatgaactgtgtca

SEQ ID NO: 24973 - DNA, 20 bp, Artificial Sequence
  Description of Artificial Sequence: Synthetic oligonucleotide
  Target: ATXN1; (+) strand; PAM type: NNGRRT; PAM sequence: TAGGAT
actcacattctgctaatcac

SEQ ID NO: 24974 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aatataacttgttccttctg

SEQ ID NO: 24975 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gaagagtagagaaaggttca

SEQ ID NO: 24976 - DNA, 20 bp, Artificial Sequence
  Description of Artificial Sequence: Synthetic oligonucleotide
  Target: ATXN1; (+) strand; PAM type: NNGRRT; PAM sequence: ATGGGT
tacaataataaacttgtctt

SEQ ID NO: 24977 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tcccaataaaagccacaact

SEQ ID NO: 24978 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gggtcatacttctctctagt

SEQ ID NO: 24979 - DNA, 20 bp, Artificial Sequence
  Description of Artificial Sequence: Synthetic oligonucleotide
  Target: ATXN1; (+) strand; PAM type: NNGRRT; PAM sequence: AAGAAT
cacagagcctggaaaagggg

SEQ ID NO: 24980 - DNA, 20 bp, Artificial Sequence
  Description of Artificial Sequence: Synthetic oligonucleotide
  Target: ATXN1; (+) strand; PAM type: NNGRRT; PAM sequence: CAGAGT
taatcaaaacaaaattcatc

SEQ ID NO: 24981 - DNA, 20 bp, Artificial Sequence
  Description of Artificial Sequence: Synthetic oligonucleotide
  Target: ATXN1; (+) strand; PAM type: NNGRRT; PAM sequence: TAGGGT
gggcaaggttaaaagggcct

SEQ ID NO: 24982 - DNA, 20 bp, Artificial Sequence
  Description of Artificial Sequence: Synthetic oligonucleotide
  Target: ATXN1; (+) strand; PAM type: NNGRRT; PAM sequence: GGGGGT
gccttagggtactctcctct

SEQ ID NO: 24983 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ggaggcatttccatacctgt

SEQ ID NO: 24984 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tcatttacaacccagaggag

SEQ ID NO: 24985 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ccggtttcatacttgacgag

SEQ ID NO: 24986 - DNA, 20 bp, Artificial Sequence
  Description of Artificial Sequence: Synthetic oligonucleotide
  Target: ATXN1; (+) strand; PAM type: NNGRRT; PAM sequence: TGGGAT
tccagataaaagtatctcct

SEQ ID NO: 24987 - DNA, 20 bp, Artificial Sequence
  Description of Artificial Sequence: Synthetic oligonucleotide
  Target: ATXN1; (+) strand; PAM type: NNGRRT; PAM sequence: CTGAGT
atctcactagaaactttcac

SEQ ID NO: 24988 - DNA, 20 bp, Artificial Sequence
  Description of Artificial Sequence: Synthetic oligonucleotide
  Target: ATXN1; (+) strand; PAM type: NNGRRT; PAM sequence: CAGAGT
agaaactttcacctgagttg

SEQ ID NO: 24989 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tcatataatcgaaattcagt

SEQ ID NO: 24990 - DNA, 20 bp, Artificial Sequence
  Description of Artificial Sequence: Synthetic oligonucleotide
  Target: ATXN1; (+) strand; PAM type: NNGRRT; PAM sequence: TTGAAT
acaaaagcatttttcctgta

SEQ ID NO: 24991 - DNA, 20 bp, Artificial Sequence
  Description of Artificial Sequence: Synthetic oligonucleotide
  Target: ATXN1; (+) strand; PAM type: NNGRRT; PAM sequence: GCGAAT
taaaacttaaatatgattga

SEQ ID NO: 24992 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tcacagtccatattaataga

SEQ ID NO: 24993 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tgtaacataagcatcacagg

SEQ ID NO: 24994 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tcctatcgctgggccaggaa

SEQ ID NO: 24995 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gtgaagtattatacaagggg

SEQ ID NO: 24996 - DNA, 20 bp, Artificial Sequence
  Description of Artificial Sequence: Synthetic oligonucleotide
  Target: ATXN1; (+) strand; PAM type: NNGRRT; PAM sequence: TGGGGT
gtattatacaaggggaagaa

SEQ ID NO: 24997 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agactctaagctgagatttc

SEQ ID NO: 24998 - DNA, 20 bp, Artificial Sequence
  Description of Artificial Sequence: Synthetic oligonucleotide
  Target: ATXN1; (+) strand; PAM type: NNGRRT; PAM sequence: CTGGGT
agacagtgcagagagaggag

SEQ ID NO: 24999 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ctaaaggctggagcaaaaaa

SEQ ID NO: 25000 - DNA, 20 bp, Artificial Sequence
  Description of Artificial Sequence: Synthetic oligonucleotide
  Target: ATXN1; (+) strand; PAM type: NNGRRT; PAM sequence: ACGAAT
tgcgatgggaccgacgtggg

SEQ ID NO: 25001 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ggacgaatacagggcaacat

SEQ ID NO: 25002 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aaaacctatggagccaggct

SEQ ID NO: 25003 - DNA, 20 bp, Artificial Sequence
  Description of Artificial Sequence: Synthetic oligonucleotide
  Target: ATXN1; (+) strand; PAM type: NNGRRT; PAM sequence: GGGAGT
ggaccatgagaacccaggga

SEQ ID NO: 25004 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gagaagagctacaacaggaa

SEQ ID NO: 25005 - DNA, 20 bp, Artificial Sequence
  Description of Artificial Sequence: Synthetic oligonucleotide
  Target: ATXN1; (+) strand; PAM type: NNGRRT; PAM sequence: CAGGGT
agctacaacaggaaaggaat

SEQ ID NO: 25006 - DNA, 20 bp, Artificial Sequence
  Description of Artificial Sequence: Synthetic oligonucleotide
  Target: ATXN1; (+) strand; PAM type: NNGRRT; PAM sequence: ATGGAT
cgtgcctctctggttcctac

SEQ ID NO: 25007 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aagaccccgaccccagagac

SEQ ID NO: 25008 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aaacacacaggtcagcaacg

SEQ ID NO: 25009 - DNA, 20 bp, Artificial Sequence
  Description of Artificial Sequence: Synthetic oligonucleotide
  Target: ATXN1; (+) strand; PAM type: NNGRRT; PAM sequence: GAGGAT
agggttgagaactgggcaga

SEQ ID NO: 25010 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ccacagccaggaaaccggca

SEQ ID NO: 25011 - DNA, 20 bp, Artificial Sequence
  Description of Artificial Sequence: Synthetic oligonucleotide
  Target: ATXN1; (+) strand; PAM type: NNGRRT; PAM sequence: GTGGGT
agccaggaaaccggcacagg

SEQ ID NO: 25012 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gaaaccggcacagggtgggt

SEQ ID NO: 25013 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cacagggtgggtgagaatca

SEQ ID NO: 25014 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gaccactcgccagcctggtg

SEQ ID NO: 25015 - DNA, 20 bp, Artificial Sequence
  Description of Artificial Sequence: Synthetic oligonucleotide
  Target: ATXN1; (+) strand; PAM type: NNGRRT; PAM sequence: CTGGGT
ttattcctgccaggttggcc

SEQ ID NO: 25016 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tagcaaataggactttttaa

SEQ ID NO: 25017 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ggaaatgttccatctctgag

SEQ ID NO: 25018 - DNA, 20 bp, Artificial Sequence
  Description of Artificial Sequence: Synthetic oligonucleotide
  Target: ATXN1; (+) strand; PAM type: NNGRRT; PAM sequence: AGGAAT
ccatctctgagagggatcaa

SEQ ID NO: 25019 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ttagtattgagccttctgat

SEQ ID NO: 25020 - DNA, 20 bp, Artificial Sequence
  Description of Artificial Sequence: Synthetic oligonucleotide
  Target: ATXN1; (+) strand; PAM type: NNGRRT; PAM sequence: TCGAAT
agtaaacaattagaaacaac

SEQ ID NO: 25021 - DNA, 20 bp, Artificial Sequence
  Description of Artificial Sequence: Synthetic oligonucleotide
  Target: ATXN1; (+) strand; PAM type: NNGRRT; PAM sequence: TAGAAT
attaagataaaacaacctga

SEQ ID NO: 25022 - DNA, 20 bp, Artificial Sequence
  Description of Artificial Sequence: Synthetic oligonucleotide
  Target: ATXN1; (+) strand; PAM type: NNGRRT; PAM sequence: AAGAAT
actgtatagctgaagttact

SEQ ID NO: 25023 - DNA, 20 bp, Artificial Sequence
  Description of Artificial Sequence: Synthetic oligonucleotide
  Target: ATXN1; (+) strand; PAM type: NNGRRT; PAM sequence: TGGAAT
aatgaacttgatttatggac

SEQ ID NO: 25024 - DNA, 20 bp, Artificial Sequence
  Description of Artificial Sequence: Synthetic oligonucleotide
  Target: ATXN1; (+) strand; PAM type: NNGRRT; PAM sequence: TGGAAT
tgatttatggactggaatgg

SEQ ID NO: 25025 - DNA, 20 bp, Artificial Sequence
  Description of Artificial Sequence: Synthetic oligonucleotide
  Target: ATXN1; (+) strand; PAM type: NNGRRT; PAM sequence: GAGGGT
acgtcactgccaggttagtg

SEQ ID NO: 25026 - DNA, 20 bp, Artificial Sequence
  Description of Artificial Sequence: Synthetic oligonucleotide
  Target: ATXN1; (+) strand; PAM type: NNGRRT; PAM sequence: GAGGGT
acgtcactgacaggttagtg

SEQ ID NO: 25027 - DNA, 20 bp, Artificial Sequence
  Description of Artificial Sequence: Synthetic oligonucleotide
  Target: ATXN1; (+) strand; PAM type: NNGRRT; PAM sequence: GAGAGT
actaccataagcaacatcta

SEQ ID NO: 25028 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ccataagcaacatctagaga

SEQ ID NO: 25029 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ttaatctttccagtgattct

SEQ ID NO: 25030 - DNA, 20 bp, Artificial Sequence
  Description of Artificial Sequence: Synthetic oligonucleotide
  Target: ATXN1; (+) strand; PAM type: NNGRRT; PAM sequence: GAGGAT
attcaacagatgaggaaatt

SEQ ID NO: 25031 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aattgaggatcacagattta

SEQ ID NO: 25032 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aagccaggagccagagccag

SEQ ID NO: 25033 - DNA, 20 bp, Artificial Sequence
  Description of Artificial Sequence: Synthetic oligonucleotide
  Target: ATXN1; (+) strand; PAM type: NNGRRT; PAM sequence: ATGAAT
agaaactattaataattgca

SEQ ID NO: 25034 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ggcatctgtatgaactgctt

SEQ ID NO: 25035 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aagttgacgcagaagagaaa

SEQ ID NO: 25036 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttctacttgcaaattaaaag

SEQ ID NO: 25037 - DNA, 20 bp, Artificial Sequence
  Description of Artificial Sequence: Synthetic oligonucleotide
  Target: ATXN1; (+) strand; PAM type: NNGRRT; PAM sequence: ATGGAT
actgcattccacctccagaa

SEQ ID NO: 25038 - DNA, 20 bp, Artificial Sequence
  Description of Artificial Sequence: Synthetic oligonucleotide
  Target: ATXN1; (+) strand; PAM type: NNGRRT; PAM sequence: TGGGGT
aggtatgaaactaatataga

SEQ ID NO: 25039 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taatatagatggggtgataa

SEQ ID NO: 25040 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gtcttgggggagccgggagc

SEQ ID NO: 25041 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ctgtacaatgtcagagatag

SEQ ID NO: 25042 - DNA, 20 bp, Artificial Sequence
  Description of Artificial Sequence: Synthetic oligonucleotide
  Target: ATXN1; (+) strand; PAM type: NNGRRT; PAM sequence: GTGAGT
ctgagacccagcaaggtaca

SEQ ID NO: 25043 - DNA, 20 bp, Artificial Sequence
  Description of Artificial Sequence: Synthetic oligonucleotide
  Target: ATXN1; (+) strand; PAM type: NNGRRT; PAM sequence: TAGGGT
agcacaccatactcactctg

SEQ ID NO: 25044 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gctcggtgtttaatctggta

SEQ ID NO: 25045 - DNA, 20 bp, Artificial Sequence
  Description of Artificial Sequence: Synthetic oligonucleotide
  Target: ATXN1; (+) strand; PAM type: NNGRRT; PAM sequence: TGGAGT
catatcccccaggcctacag

SEQ ID NO: 25046 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aactcatcagaaaataaaga

SEQ ID NO: 25047 - DNA, 20 bp, Artificial Sequence
  Description of Artificial Sequence: Synthetic oligonucleotide
  Target: ATXN1; (+) strand; PAM type: NNGRRT; PAM sequence: GGGAAT
taaagagggaattaccaaag

SEQ ID NO: 25048 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cttcccggttagtcatatgt

SEQ ID NO: 25049 - DNA, 20 bp, Artificial Sequence
  Description of Artificial Sequence: Synthetic oligonucleotide
  Target: ATXN1; (+) strand; PAM type: NNGRRT; PAM sequence: ACGAAT
tgaagctgccaggctagggc

SEQ ID NO: 25050 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gcatcctcttctcgatttcc

SEQ ID NO: 25051 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttcttctctatcatcttgac

SEQ ID NO: 25052 - DNA, 20 bp, Artificial Sequence
  Description of Artificial Sequence: Synthetic oligonucleotide
  Target: ATXN1; (+) strand; PAM type: NNGRRT; PAM sequence: GGGGAT
ctgggcgaggcaggggcaga

SEQ ID NO: 25053 - DNA, 20 bp, Artificial Sequence
  Description of Artificial Sequence: Synthetic oligonucleotide
  Target: ATXN1; (+) strand; PAM type: NNGRRT; PAM sequence: GTGAGT
gaggcaggggcagaggggat

SEQ ID NO: 25054 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tgacccagtgaagttctttt

SEQ ID NO: 25055 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tctcgctgagactcttgatg

SEQ ID NO: 25056 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ctcttgatgctgaataacat

SEQ ID NO: 25057 - DNA, 20 bp, Artificial Sequence
  Description of Artificial Sequence: Synthetic oligonucleotide
  Target: ATXN1; (+) strand; PAM type: NNGRRT; PAM sequence: ACGGAT
acttaagccaatcccctgaa

SEQ ID NO: 25058 - DNA, 20 bp, Artificial Sequence
  Description of Artificial Sequence: Synthetic oligonucleotide
  Target: ATXN1; (+) strand; PAM type: NNGRRT; PAM sequence: AGGAAT
aataattattgaaagtgcat

SEQ ID NO: 25059 - DNA, 20 bp, Artificial Sequence
  Description of Artificial Sequence: Synthetic oligonucleotide
  Target: ATXN1; (+) strand; PAM type: NNGRRT; PAM sequence: ATGAGT
cataggaatctcaaggagat

SEQ ID NO: 25060 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aatctcaaggagatatgagt

SEQ ID NO: 25061 - DNA, 20 bp, Artificial Sequence
  Description of Artificial Sequence: Synthetic oligonucleotide
  Target: ATXN1; (+) strand; PAM type: NNGRRT; PAM sequence: GAGAGT
agggcttaaggaacagggct

SEQ ID NO: 25062 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acagggctgagagtgtagac

SEQ ID NO: 25063 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ctacctcaaaggactgtaat

SEQ ID NO: 25064 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ggattcaataagttaatatg

SEQ ID NO: 25065 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agacaagaacgatctgcccc

SEQ ID NO: 25066 - DNA, 20 bp, Artificial Sequence
  Description of Artificial Sequence: Synthetic oligonucleotide
  Target: ATXN1; (+) strand; PAM type: NNGRRT; PAM sequence: AAGAGT
cacacacatctcacatttta

SEQ ID NO: 25067 - DNA, 20 bp, Artificial Sequence
  Description of Artificial Sequence: Synthetic oligonucleotide
  Target: ATXN1; (+) strand; PAM type: NNGRRT; PAM sequence: GGGAAT
gagtctgcagaaagcctcca

SEQ ID NO: 25068 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ggtttatcaaagtacagtaa

SEQ ID NO: 25069 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ccacaaatgaacaattgcta

SEQ ID NO: 25070 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atttacgcatatcatgtgag

SEQ ID NO: 25071 - DNA, 20 bp, Artificial Sequence
  Description of Artificial Sequence: Synthetic oligonucleotide
  Target: ATXN1; (+) strand; PAM type: NNGRRT; PAM sequence: TGGAAT
agaaaagatcaaagaaatgc

SEQ ID NO: 25072 - DNA, 20 bp, Artificial Sequence
  Description of Artificial Sequence: Synthetic oligonucleotide
  Target: ATXN1; (+) strand; PAM type: NNGRRT; PAM sequence: AAGGAT
aactgtttagaggaaaatag

SEQ ID NO: 25073 - DNA, 20 bp, Artificial Sequence
  Description of Artificial Sequence: Synthetic oligonucleotide
  Target: ATXN1; (+) strand; PAM type: NNGRRT; PAM sequence: CTGAAT
ttaacgagataccgcatacg

SEQ ID NO: 25074 - DNA, 20 bp, Artificial Sequence
  Description of Artificial Sequence: Synthetic oligonucleotide
  Target: ATXN1; (+) strand; PAM type: NNGRRT; PAM sequence: CTGAGT
cattgaactgtagttcagca

SEQ ID NO: 25075 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ccaaggtgcctgagctgcag

SEQ ID NO: 25076 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tacaccagctgacgtcatcc

SEQ ID NO: 25077 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tgaattcagtcatccccctc

SEQ ID NO: 25078 - DNA, 20 bp, Artificial Sequence
  Description of Artificial Sequence: Synthetic oligonucleotide
  Target: ATXN1; (+) strand; PAM type: NNGRRT; PAM sequence: TCGAAT
ccatactctctactgtctgc

SEQ ID NO: 25079 - DNA, 20 bp, Artificial Sequence
  Description of Artificial Sequence: Synthetic oligonucleotide
  Target: ATXN1; (+) strand; PAM type: NNGRRT; PAM sequence: CTGAAT
tcctactcagcgtcactctt

SEQ ID NO: 25080 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tattcgtattcattatttca

SEQ ID NO: 25081 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tagttttaaaaaaattcaca

SEQ ID NO: 25082 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaaaaattcacaatgaataa

SEQ ID NO: 25083 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aattcacaatgaataaatga

SEQ ID NO: 25084 - DNA, 20 bp, Artificial Sequence
  Description of Artificial Sequence: Synthetic oligonucleotide
  Target: ATXN1; (+) strand; PAM type: NNGRRT; PAM sequence: CTGAAT
atgtaggtttaagaaaaaaa

SEQ ID NO: 25085 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aggtttaagaaaaaaactga

SEQ ID NO: 25086 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aaaaaactgaatgaatataa

SEQ ID NO: 25087 - DNA, 20 bp, Artificial Sequence
  Description of Artificial Sequence: Synthetic oligonucleotide
  Target: ATXN1; (+) strand; PAM type: NNGRRT; PAM sequence: ATGAAT
tgaatataaaagagtacaac

SEQ ID NO: 25088 - DNA, 20 bp, Artificial Sequence
  Description of Artificial Sequence: Synthetic oligonucleotide
  Target: ATXN1; (+) strand; PAM type: NNGRRT; PAM sequence: GAGGAT
ttccccaaagatctaaatgt

SEQ ID NO: 25089 - DNA, 20 bp, Artificial Sequence
  Description of Artificial Sequence: Synthetic oligonucleotide
  Target: ATXN1; (+) strand; PAM type: NNGRRT; PAM sequence: ATGAGT
cctagcacataaccgttaaa

SEQ ID NO: 25090 - DNA, 20 bp, Artificial Sequence
  Description of Artificial Sequence: Synthetic oligonucleotide
  Target: ATXN1; (+) strand; PAM type: NNGRRT; PAM sequence: TGGAGT
ttttttttttttttttgaga

SEQ ID NO: 25091 - DNA, 20 bp, Artificial Sequence
  Description of Artificial Sequence: Synthetic oligonucleotide
  Target: ATXN1; (+) strand; PAM type: NNGRRT; PAM sequence: TGGAGT
tctcactctgtcgcccaggc

SEQ ID NO: 25092 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctcactgcaacctctgcctc

SEQ ID NO: 25093 - DNA, 20 bp, Artificial Sequence
  Description of Artificial Sequence: Synthetic oligonucleotide
  Target: ATXN1; (+) strand; PAM type: NNGRRT; PAM sequence: TGGGAT
gcctcagtgtcccaagtagc

SEQ ID NO: 25094 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ttttatatttttagtagaga

SEQ ID NO: 25095 - DNA, 20 bp, Artificial Sequence
  Description of Artificial Sequence: Synthetic oligonucleotide
  Target: ATXN1; (+) strand; PAM type: NNGRRT; PAM sequence: TGGGAT
acctcagcctcccaaagtgc

SEQ ID NO: 25096 - DNA, 20 bp, Artificial Sequence
  Description of Artificial Sequence: Synthetic oligonucleotide
  Target: ATXN1; (+) strand; PAM type: NNGRRT; PAM sequence: AGGAAT
tccacagccaataaaatgta

SEQ ID NO: 25097 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aatccagttccatattttac

SEQ ID NO: 25098 - DNA, 20 bp, Artificial Sequence
  Description of Artificial Sequence: Synthetic oligonucleotide
  Target: ATXN1; (+) strand; PAM type: NNGRRT; PAM sequence: GAGAGT
cacatgcatcccatcagtca

SEQ ID NO: 25099 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tcagagagttgtgataaatt

SEQ ID NO: 25100 - DNA, 20 bp, Artificial Sequence
  Description of Artificial Sequence: Synthetic oligonucleotide
  Target: ATXN1; (+) strand; PAM type: NNGRRT; PAM sequence: CAGGGT
tgcagagccgtagatgtcta

SEQ ID NO: 25101 - DNA, 20 bp, Artificial Sequence
  Description of Artificial Sequence: Synthetic oligonucleotide
  Target: ATXN1; (+) strand; PAM type: NNGRRT; PAM sequence: GTGGGT
gagccgtagatgtctacagg

SEQ ID NO: 25102 - DNA, 20 bp, Artificial Sequence
  Description of Artificial Sequence: Synthetic oligonucleotide
  Target: ATXN1; (+) strand; PAM type: NNGRRT; PAM sequence: AGGGAT
ccataacaatcaacctgttg

SEQ ID NO: 25103 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atattacctccatcttatac

SEQ ID NO: 25104 - DNA, 20 bp, Artificial Sequence
  Description of Artificial Sequence: Synthetic oligonucleotide
  Target: ATXN1; (+) strand; PAM type: NNGRRT; PAM sequence: ATGGGT
gctccagatcttaagtccag

SEQ ID NO: 25105 - DNA, 20 bp, Artificial Sequence
  Description of Artificial Sequence: Synthetic oligonucleotide
  Target: ATXN1; (+) strand; PAM type: NNGRRT; PAM sequence: GAGAAT
tgctcttatctaagatgcca

SEQ ID NO: 25106 - DNA, 20 bp, Artificial Sequence
  Description of Artificial Sequence: Synthetic oligonucleotide
  Target: ATXN1; (+) strand; PAM type: NNGRRT; PAM sequence: ATGAGT
atccatctacctcttgaaaa

SEQ ID NO: 25107 - DNA, 20 bp, Artificial Sequence
  Description of Artificial Sequence: Synthetic oligonucleotide
  Target: ATXN1; (+) strand; PAM type: NNGRRT; PAM sequence: TAGAAT
aatgggagatttgctaaaag

SEQ ID NO: 25108 - DNA, 20 bp, Artificial Sequence
  Description of Artificial Sequence: Synthetic oligonucleotide
  Target: ATXN1; (+) strand; PAM type: NNGRRT; PAM sequence: AAGAGT
tctacagaacataacttagg

SEQ ID NO: 25109 - DNA, 20 bp, Artificial Sequence
  Description of Artificial Sequence: Synthetic oligonucleotide
  Target: ATXN1; (+) strand; PAM type: NNGRRT; PAM sequence: AGGGGT
gctggaagaccggccgaccc

SEQ ID NO: 25110 - DNA, 20 bp, Artificial Sequence
  Description of Artificial Sequence: Synthetic oligonucleotide
  Target: ATXN1; (+) strand; PAM type: NNGRRT; PAM sequence: TAGGGT
acattctgattcatcaagtc

SEQ ID NO: 25111 - DNA, 20 bp, Artificial Sequence
  Description of Artificial Sequence: Synthetic oligonucleotide
  Target: ATXN1; (+) strand; PAM type: NNGRRT; PAM sequence: ATGAGT
cctttcttcaatagagaacc

SEQ ID NO: 25112 - DNA, 20 bp, Artificial Sequence
  Description of Artificial Sequence: Synthetic oligonucleotide
  Target: ATXN1; (+) strand; PAM type: NNGRRT; PAM sequence: CAGAGT
cttcccacactatgcccaaa

SEQ ID NO: 25113 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggaggaggagattgctgtac

SEQ ID NO: 25114 - DNA, 20 bp, Artificial Sequence
  Description of Artificial Sequence: Synthetic oligonucleotide
  Target: ATXN1; (+) strand; PAM type: NNGRRT; PAM sequence: TTGAAT
atgacaaacaaatctgcagc

SEQ ID NO: 25115 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gatgctcctgcaatggtcga

SEQ ID NO: 25116 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aggaaatccaaaatgaaaaa

SEQ ID NO: 25117 - DNA, 20 bp, Artificial Sequence
  Description of Artificial Sequence: Synthetic oligonucleotide
  Target: ATXN1; (+) strand; PAM type: NNGRRT; PAM sequence: GAGAAT
cattcggcattctgttgtat

SEQ ID NO: 25118 - DNA, 20 bp, Artificial Sequence
  Description of Artificial Sequence: Synthetic oligonucleotide
  Target: ATXN1; (+) strand; PAM type: NNGRRT; PAM sequence: GAGGAT
catcccttccatcaaattaa

SEQ ID NO: 25119 - DNA, 20 bp, Artificial Sequence
  Description of Artificial Sequence: Synthetic oligonucleotide
  Target: ATXN1; (+) strand; PAM type: NNGRRT; PAM sequence: AGGAGT
aacacatgctggtaactaca

SEQ ID NO: 25120 - DNA, 20 bp, Artificial Sequence
  Description of Artificial Sequence: Synthetic oligonucleotide
  Target: ATXN1; (+) strand; PAM type: NNGRRT; PAM sequence: ATGGAT
agtatcaggtgaaaatgggc

SEQ ID NO: 25121 - DNA, 20 bp, Artificial Sequence
  Description of Artificial Sequence: Synthetic oligonucleotide
  Target: ATXN1; (+) strand; PAM type: NNGRRT; PAM sequence: TTGAAT
caggtgaaaatgggcatgga

SEQ ID NO: 25122 - DNA, 20 bp, Artificial Sequence
  Description of Artificial Sequence: Synthetic oligonucleotide
  Target: ATXN1; (+) strand; PAM type: NNGRRT; PAM sequence: TGGAAT
ctattagcataccagtccaa

SEQ ID NO: 25123 - DNA, 20 bp, Artificial Sequence
  Description of Artificial Sequence: Synthetic oligonucleotide
  Target: ATXN1; (+) strand; PAM type: NNGRRT; PAM sequence: CTGAAT
cactaaactttatttaaata

SEQ ID NO: 25124 - DNA, 20 bp, Artificial Sequence
  Description of Artificial Sequence: Synthetic oligonucleotide
  Target: ATXN1; (+) strand; PAM type: NNGRRT; PAM sequence: ATGAAT
taaaaattttccattgtatg

SEQ ID NO: 25125 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aattttccattgtatgatga

SEQ ID NO: 25126 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ttccattgtatgatgaatga

SEQ ID NO: 25127 - DNA, 20 bp, Artificial Sequence
  Description of Artificial Sequence: Synthetic oligonucleotide
  Target: ATXN1; (+) strand; PAM type: NNGRRT; PAM sequence: GTGAAT
tatgatgaatgagtgaatgt

SEQ ID NO: 25128 - DNA, 20 bp, Artificial Sequence
  Description of Artificial Sequence: Synthetic oligonucleotide
  Target: ATXN1; (+) strand; PAM type: NNGRRT; PAM sequence: ATGGAT
atgaatgagtgaatgtgtga

SEQ ID NO: 25129 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atgagtgaatgtgtgaatgg

SEQ ID NO: 25130 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gtgaatggatgaatgaaaga

SEQ ID NO: 25131 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atggatgaatgaaagaaaga

SEQ ID NO: 25132 - DNA, 20 bp, Artificial Sequence
  Description of Artificial Sequence: Synthetic oligonucleotide
  Target: ATXN1; (+) strand; PAM type: NNGRRT; PAM sequence: ATGAAT
atgaatgaaagaaagaatga

SEQ ID NO: 25133 - DNA, 20 bp, Artificial Sequence
  Description of Artificial Sequence: Synthetic oligonucleotide
  Target: ATXN1; (+) strand; PAM type: NNGRRT; PAM sequence: CAGGGT
aatttttttaaaatcagtag

SEQ ID NO: 25134 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ataaaatcatccccaaacta

SEQ ID NO: 25135 - DNA, 20 bp, Artificial Sequence
  Description of Artificial Sequence: Synthetic oligonucleotide
  Target: ATXN1; (+) strand; PAM type: NNGRRT; PAM sequence: TTGGGT
aggctgattttaaacttagt

SEQ ID NO: 25136 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gaaggaggcccaggtttata

SEQ ID NO: 25137 - DNA, 20 bp, Artificial Sequence
  Description of Artificial Sequence: Synthetic oligonucleotide
  Target: ATXN1; (+) strand; PAM type: NNGRRT; PAM sequence: ATGAAT
aaagaaactattctggagct

SEQ ID NO: 25138 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ctatgaatatgatctccaat

SEQ ID NO: 25139 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ggtaagtgagccaattatcc

SEQ ID NO: 25140 - DNA, 20 bp, Artificial Sequence
  Description of Artificial Sequence: Synthetic oligonucleotide
  Target: ATXN1; (+) strand; PAM type: NNGRRT; PAM sequence: AGGAAT
gaggactgatatgcaaaaga

SEQ ID NO: 25141 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tccctccaccaagaagcctg

SEQ ID NO: 25142 - DNA, 20 bp, Artificial Sequence
  Description of Artificial Sequence: Synthetic oligonucleotide
  Target: ATXN1; (+) strand; PAM type: NNGRRT; PAM sequence: AAGGAT
tttaatcttagtacttcttt

SEQ ID NO: 25143 - DNA, 20 bp, Artificial Sequence
  Description of Artificial Sequence: Synthetic oligonucleotide
  Target: ATXN1; (+) strand; PAM type: NNGRRT; PAM sequence: GAGGAT
aggatgaggaagcagggagg

SEQ ID NO: 25144 - DNA, 20 bp, Artificial Sequence
  Description of Artificial Sequence: Synthetic oligonucleotide
  Target: ATXN1; (+) strand; PAM type: NNGRRT; PAM sequence: GAGAGT
tttatgagctcaccagttgg

SEQ ID NO: 25145 - DNA, 20 bp, Artificial Sequence
  Description of Artificial Sequence: Synthetic oligonucleotide
  Target: ATXN1; (+) strand; PAM type: NNGRRT; PAM sequence: TAGAGT
acctggcagataaggtttta

SEQ ID NO: 25146 - DNA, 20 bp, Artificial Sequence
  Description of Artificial Sequence: Synthetic oligonucleotide
  Target: ATXN1; (+) strand; PAM type: NNGRRT; PAM sequence: GAGGGT
tagtttgctgaagtgcagag

SEQ ID NO: 25147 - DNA, 20 bp, Artificial Sequence
  Description of Artificial Sequence: Synthetic oligonucleotide
  Target: ATXN1; (+) strand; PAM type: NNGRRT; PAM sequence: ATGAGT
gaagattactttactcttgc

SEQ ID NO: 25148 - DNA, 20 bp, Artificial Sequence
  Description of Artificial Sequence: Synthetic oligonucleotide
  Target: ATXN1; (+) strand; PAM type: NNGRRT; PAM sequence: TAGGAT
atttgtgttgctgcactagt

SEQ ID NO: 25149 - DNA, 20 bp, Artificial Sequence
  Description of Artificial Sequence: Synthetic oligonucleotide
  Target: ATXN1; (+) strand; PAM type: NNGRRT; PAM sequence: GAGAGT
gcactagttaggataataca

SEQ ID NO: 25150 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tccatcagagggaagaaggc

SEQ ID NO: 25151 - DNA, 20 bp, Artificial Sequence
  Description of Artificial Sequence: Synthetic oligonucleotide
  Target: ATXN1; (+) strand; PAM type: NNGRRT; PAM sequence: TGGAAT
acaataatatacaccaaaaa

SEQ ID NO: 25152 - DNA, 20 bp, Artificial Sequence
  Description of Artificial Sequence: Synthetic oligonucleotide
  Target: ATXN1; (+) strand; PAM type: NNGRRT; PAM sequence: AAGGAT
atattttctttgaacgttag

SEQ ID NO: 25153 - DNA, 20 bp, Artificial Sequence
  Description of Artificial Sequence: Synthetic oligonucleotide
  Target: ATXN1; (+) strand; PAM type: NNGRRT; PAM sequence: AAGAGT
taagtgtaaaaaaaaaaaaa

SEQ ID NO: 25154 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tcggggaaacctctgccctc

SEQ ID NO: 25155 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gccctcttgagtctcaaatt

SEQ ID NO: 25156 - DNA, 20 bp, Artificial Sequence
  Description of Artificial Sequence: Synthetic oligonucleotide
  Target: ATXN1; (+) strand; PAM type: NNGRRT; PAM sequence: ATGAAT
caaattctgagtacactacc

SEQ ID NO: 25157 - DNA, 20 bp, Artificial Sequence
  Description of Artificial Sequence: Synthetic oligonucleotide
  Target: ATXN1; (+) strand; PAM type: NNGRRT; PAM sequence: TAGGAT
tctggaaagtaattttcagg

SEQ ID NO: 25158 - DNA, 20 bp, Artificial Sequence
  Description of Artificial Sequence: Synthetic oligonucleotide
  Target: ATXN1; (+) strand; PAM type: NNGRRT; PAM sequence: TGGGAT
cattttcattactccacaaa

SEQ ID NO: 25159 - DNA, 20 bp, Artificial Sequence
  Description of Artificial Sequence: Synthetic oligonucleotide
  Target: ATXN1; (+) strand; PAM type: NNGRRT; PAM sequence: TGGGAT
taaacgtgttttggtacatt

SEQ ID NO: 25160 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atccataaatataattataa

SEQ ID NO: 25161 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tatcacttcttaaaaaaatt

SEQ ID NO: 25162 - DNA, 20 bp, Artificial Sequence
  Description of Artificial Sequence: Synthetic oligonucleotide
  Target: ATXN1; (+) strand; PAM type: NNGRRT; PAM sequence: ATGAGT
acttcttaaaaaaattttga

SEQ ID NO: 25163 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gaaactaatcattcgaacta

SEQ ID NO: 25164 - DNA, 20 bp, Artificial Sequence
  Description of Artificial Sequence: Synthetic oligonucleotide
  Target: ATXN1; (+) strand; PAM type: NNGRRT; PAM sequence: AAGAAT
tttcagataactacagttta

SEQ ID NO: 25165 - DNA, 20 bp, Artificial Sequence
  Description of Artificial Sequence: Synthetic oligonucleotide
  Target: ATXN1; (+) strand; PAM type: NNGRRT; PAM sequence: GTGAGT
tcccacatttacctacttac

SEQ ID NO: 25166 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ttacctacttacgtgagttt

SEQ ID NO: 25167 - DNA, 20 bp, Artificial Sequence
  Description of Artificial Sequence: Synthetic oligonucleotide
  Target: ATXN1; (+) strand; PAM type: NNGRRT; PAM sequence: ATGAGT
aacttttaataggaaacaaa

SEQ ID NO: 25168 - DNA, 20 bp, Artificial Sequence
  Description of Artificial Sequence: Synthetic oligonucleotide
  Target: ATXN1; (+) strand; PAM type: NNGRRT; PAM sequence: CAGAAT
gtaaaatccacttgacattt

SEQ ID NO: 25169 - DNA, 20 bp, Artificial Sequence
  Description of Artificial Sequence: Synthetic oligonucleotide
  Target: ATXN1; (+) strand; PAM type: NNGRRT; PAM sequence: AGGAGT
tccataatgacaacaaaaac

SEQ ID NO: 25170 - DNA, 20 bp, Artificial Sequence
  Description of Artificial Sequence: Synthetic oligonucleotide
  Target: ATXN1; (+) strand; PAM type: NNGRRT; PAM sequence: AAGAGT
gacatgtaatcttgtggcta

SEQ ID NO: 25171 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ttttttatacttattttcac

SEQ ID NO: 25172 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tttttctatatgttgcaaaa

SEQ ID NO: 25173 - DNA, 20 bp, Artificial Sequence
  Description of Artificial Sequence: Synthetic oligonucleotide
  Target: ATXN1; (+) strand; PAM type: NNGRRT; PAM sequence: TTGAGT
tatttaccaccttataaaag

SEQ ID NO: 25174 - DNA, 20 bp, Artificial Sequence
  Description of Artificial Sequence: Synthetic oligonucleotide
  Target: ATXN1; (+) strand; PAM type: NNGRRT; PAM sequence: ATGAAT
cttcatctgaccaggccaca

SEQ ID NO: 25175 - DNA, 20 bp, Artificial Sequence
  Description of Artificial Sequence: Synthetic oligonucleotide
  Target: ATXN1; (+) strand; PAM type: NNGRRT; PAM sequence: GGGAAT
taaaaactcataaaccccct

SEQ ID NO: 25176 - DNA, 20 bp, Artificial Sequence
  Description of Artificial Sequence: Synthetic oligonucleotide
  Target: ATXN1; (+) strand; PAM type: NNGRRT; PAM sequence: TAGAGT
actcataaaccccctgggaa

SEQ ID NO: 25177 - DNA, 20 bp, Artificial Sequence
  Description of Artificial Sequence: Synthetic oligonucleotide
  Target: ATXN1; (+) strand; PAM type: NNGRRT; PAM sequence: TTGAGT
taaaccccctgggaatagag

SEQ ID NO: 25178 - DNA, 20 bp, Artificial Sequence
  Description of Artificial Sequence: Synthetic oligonucleotide
  Target: ATXN1; (+) strand; PAM type: NNGRRT; PAM sequence: CAGGGT
ttatcttttctttcaaatac

SEQ ID NO: 25179 - DNA, 20 bp, Artificial Sequence
  Description of Artificial Sequence: Synthetic oligonucleotide
  Target: ATXN1; (+) strand; PAM type: NNGRRT; PAM sequence: TTGGAT
ccgccccctgccccacttag

SEQ ID NO: 25180 - DNA, 20 bp, Artificial Sequence
  Description of Artificial Sequence: Synthetic oligonucleotide
  Target: ATXN1; (+) strand; PAM type: NNGRRT; PAM sequence: TAGAAT
tggtgccctaatgcaaagac

SEQ ID NO: 25181 - DNA, 20 bp, Artificial Sequence
  Description of Artificial Sequence: Synthetic oligonucleotide
  Target: ATXN1; (+) strand; PAM type: NNGRRT; PAM sequence: AAGAAT
acagccaatagatccaaatt

SEQ ID NO: 25182 - DNA, 20 bp, Artificial Sequence
  Description of Artificial Sequence: Synthetic oligonucleotide
  Target: ATXN1; (+) strand; PAM type: NNGRRT; PAM sequence: ATGAAT
ccaatagatccaaattaaga

SEQ ID NO: 25183 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aaattaagaatgaatacatt

SEQ ID NO: 25184 - DNA, 20 bp, Artificial Sequence
  Description of Artificial Sequence: Synthetic oligonucleotide
  Target: ATXN1; (+) strand; PAM type: NNGRRT; PAM sequence: GGGAAT
aagttttaaaatgtgacaat

SEQ ID NO: 25185 - DNA, 20 bp, Artificial Sequence
  Description of Artificial Sequence: Synthetic oligonucleotide
  Target: ATXN1; (+) strand; PAM type: NNGRRT; PAM sequence: CCGAAT
tgacaatgggaatatatttt

SEQ ID NO: 25186 - DNA, 20 bp, Artificial Sequence
  Description of Artificial Sequence: Synthetic oligonucleotide
  Target: ATXN1; (+) strand; PAM type: NNGRRT; PAM sequence: CTGAGT
tttccgaataagttattccc

SEQ ID NO: 25187 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tgaacgctcttcacacttga

SEQ ID NO: 25188 - DNA, 20 bp, Artificial Sequence
  Description of Artificial Sequence: Synthetic oligonucleotide
  Target: ATXN1; (+) strand; PAM type: NNGRRT; PAM sequence: CAGGAT
ctgttcacaataaacaccag

SEQ ID NO: 25189 - DNA, 20 bp, Artificial Sequence
  Description of Artificial Sequence: Synthetic oligonucleotide
  Target: ATXN1; (+) strand; PAM type: NNGRRT; PAM sequence: TTGAGT
gttggtctcctttataaaag

SEQ ID NO: 25190 - DNA, 20 bp, Artificial Sequence
  Description of Artificial Sequence: Synthetic oligonucleotide
  Target: ATXN1; (+) strand; PAM type: NNGRRT; PAM sequence: TGGAGT
agaagatgcaattgaaatag

SEQ ID NO: 25191 - DNA, 20 bp, Artificial Sequence
  Description of Artificial Sequence: Synthetic oligonucleotide
  Target: ATXN1; (+) strand; PAM type: NNGRRT; PAM sequence: TGGAGT
aatgctgtgcataaaacact

SEQ ID NO: 25192 - DNA, 20 bp, Artificial Sequence
  Description of Artificial Sequence: Synthetic oligonucleotide
  Target: ATXN1; (+) strand; PAM type: NNGRRT; PAM sequence: CTGAAT
caggcacaagacaaacccac

SEQ ID NO: 25193 - DNA, 20 bp, Artificial Sequence
  Description of Artificial Sequence: Synthetic oligonucleotide
  Target: ATXN1; (+) strand; PAM type: NNGRRT; PAM sequence: ATGAGT
tggcagcctgatctaattac

SEQ ID NO: 25194 - DNA, 20 bp, Artificial Sequence
  Description of Artificial Sequence: Synthetic oligonucleotide
  Target: ATXN1; (+) strand; PAM type: NNGRRT; PAM sequence: TGGAGT
attacatgagtgatcaggac

SEQ ID NO: 25195 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ttatggtgcaatccctttcc

SEQ ID NO: 25196 - DNA, 20 bp, Artificial Sequence
  Description of Artificial Sequence: Synthetic oligonucleotide
  Target: ATXN1; (+) strand; PAM type: NNGRRT; PAM sequence: CAGGAT
cctttccaagagttcctgtg

SEQ ID NO: 25197 - DNA, 20 bp, Artificial Sequence
  Description of Artificial Sequence: Synthetic oligonucleotide
  Target: ATXN1; (+) strand; PAM type: NNGRRT; PAM sequence: AAGGGT
tttacccatcaaataaaccg

SEQ ID NO: 25198 - DNA, 20 bp, Artificial Sequence
  Description of Artificial Sequence: Synthetic oligonucleotide
  Target: ATXN1; (+) strand; PAM type: NNGRRT; PAM sequence: CAGGAT
acattcccgtgcatgcacga

SEQ ID NO: 25199 - DNA, 20 bp, Artificial Sequence
  Description of Artificial Sequence: Synthetic oligonucleotide
  Target: ATXN1; (+) strand; PAM type: NNGRRT; PAM sequence: GTGGGT
aaggcattagtttttattct

SEQ ID NO: 25200 - DNA, 20 bp, Artificial Sequence
  Description of Artificial Sequence: Synthetic oligonucleotide
  Target: ATXN1; (+) strand; PAM type: NNGRRT; PAM sequence: TAGGGT
tttttattctgtgggtgtaa

SEQ ID NO: 25201 - DNA, 20 bp, Artificial Sequence
  Description of Artificial Sequence: Synthetic oligonucleotide
  Target: ATXN1; (+) strand; PAM type: NNGRRT; PAM sequence: GTGGAT
aattttgctaattgtatcct

SEQ ID NO: 25202 - DNA, 20 bp, Artificial Sequence
  Description of Artificial Sequence: Synthetic oligonucleotide
  Target: ATXN1; (+) strand; PAM type: NNGRRT; PAM sequence: AAGAAT
gtggatctcgcagggaagct

SEQ ID NO: 25203 - DNA, 20 bp, Artificial Sequence
  Description of Artificial Sequence: Synthetic oligonucleotide
  Target: ATXN1; (+) strand; PAM type: NNGRRT; PAM sequence: AGGAGT
cggggacagaaccagtttgg

SEQ ID NO: 25204 - DNA, 20 bp, Artificial Sequence
  Description of Artificial Sequence: Synthetic oligonucleotide
  Target: ATXN1; (+) strand; PAM type: NNGRRT; PAM sequence: TAGGAT
ttatattacccttttatctg

SEQ ID NO: 25205 - DNA, 20 bp, Artificial Sequence
  Description of Artificial Sequence: Synthetic oligonucleotide
  Target: ATXN1; (+) strand; PAM type: NNGRRT; PAM sequence: CCGAAT
agagcagccacgggctcgaa

SEQ ID NO: 25206 - DNA, 20 bp, Artificial Sequence
  Description of Artificial Sequence: Synthetic oligonucleotide
  Target: ATXN1; (+) strand; PAM type: NNGRRT; PAM sequence: ACGGAT
aatccccgccgtccttagaa

SEQ ID NO: 25207 - DNA, 20 bp, Artificial Sequence
  Description of Artificial Sequence: Synthetic oligonucleotide
  Target: ATXN1; (+) strand; PAM type: NNGRRT; PAM sequence: CAGAGT
tgttttgttttgttttctgg

SEQ ID NO: 25208 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gctcaatctccctagaaaac

SEQ ID NO: 25209 - DNA, 20 bp, Artificial Sequence
  Description of Artificial Sequence: Synthetic oligonucleotide
  Target: ATXN1; (+) strand; PAM type: NNGRRT; PAM sequence: CGGAGT
caaaatgaaagcacaagcca

SEQ ID NO: 25210 - DNA, 20 bp, Artificial Sequence
  Description of Artificial Sequence: Synthetic oligonucleotide
  Target: ATXN1; (+) strand; PAM type: NNGRRT; PAM sequence: AGGGGT
ctgaaggcggggggctgaag

SEQ ID NO: 25211 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gaagaggggtcggggcgctg

SEQ ID NO: 25212 - DNA, 20 bp, Artificial Sequence
  Description of Artificial Sequence: Synthetic oligonucleotide
  Target: ATXN1; (+) strand; PAM type: NNGRRT; PAM sequence: GGGAGT
gaggaggcggcggcgccccc

SEQ ID NO: 25213 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ggcggcgcccccgggagtgg

SEQ ID NO: 25214 - DNA, 20 bp, Artificial Sequence
  Description of Artificial Sequence: Synthetic oligonucleotide
  Target: ATXN1; (+) strand; PAM type: NNGRRT; PAM sequence: CAGAGT
gcagagtctccggcccggcc

SEQ ID NO: 25215 - DNA, 20 bp, Artificial Sequence
  Description of Artificial Sequence: Synthetic oligonucleotide
  Target: ATXN1; (+) strand; PAM type: NNGRRT; PAM sequence: GCGGGT
gcggctcctcgtctcctgcc

SEQ ID NO: 25216 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caccgccctctccggggagg

SEQ ID NO: 25217 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ccgccggccgcccctgcgcc

SEQ ID NO: 25218 - DNA, 20 bp, Artificial Sequence
  Description of Artificial Sequence: Synthetic oligonucleotide
  Target: ATXN1; (+) strand; PAM type: NNGRRT; PAM sequence: GGGGGT
gccgcccctgcgcccagagt

SEQ ID NO: 25219 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ctgttttccgtgcagccgat

SEQ ID NO: 25220 - DNA, 20 bp, Artificial Sequence
  Description of Artificial Sequence: Synthetic oligonucleotide
  Target: ATXN1; (+) strand; PAM type: NNGRRT; PAM sequence: TTGGGT
ccgtgcagccgattggggtt

SEQ ID NO: 25221 - DNA, 20 bp, Artificial Sequence
  Description of Artificial Sequence: Synthetic oligonucleotide
  Target: ATXN1; (+) strand; PAM type: NNGRRT; PAM sequence: AGGGAT
tctcgggagatcgggggagg

SEQ ID NO: 25222 - DNA, 20 bp, Artificial Sequence
  Description of Artificial Sequence: Synthetic oligonucleotide
  Target: ATXN1; (+) strand; PAM type: NNGRRT; PAM sequence: GGGAAT
taatctaaataaggggagaa

SEQ ID NO: 25223 - DNA, 20 bp, Artificial Sequence
  Description of Artificial Sequence: Synthetic oligonucleotide
  Target: ATXN1; (+) strand; PAM type: NNGRRT; PAM sequence: AAGAAT
agggaatgggggagggggga

SEQ ID NO: 25224 - DNA, 20 bp, Artificial Sequence
  Description of Artificial Sequence: Synthetic oligonucleotide
  Target: ATXN1; (+) strand; PAM type: NNGRRT; PAM sequence: ATGGAT
tcacttactgtaaagtgtaa

SEQ ID NO: 25225 - DNA, 20 bp, Artificial Sequence
  Description of Artificial Sequence: Synthetic oligonucleotide
  Target: ATXN1; (+) strand; PAM type: NNGRRT; PAM sequence: TGGGGT
ctgtaaagtgtaaatggatc

SEQ ID NO: 25226 - DNA, 20 bp, Artificial Sequence
  Description of Artificial Sequence: Synthetic oligonucleotide
  Target: ATXN1; (+) strand; PAM type: NNGRRT; PAM sequence: TTGGAT
gctgctccacggggcttgtt

SEQ ID NO: 25227 - DNA, 20 bp, Artificial Sequence
  Description of Artificial Sequence: Synthetic oligonucleotide
  Target: ATXN1; (+) strand; PAM type: NNGRRT; PAM sequence: AAGGAT
ggctgccgccgccgcagctc

SEQ ID NO: 25228 - DNA, 20 bp, Artificial Sequence
  Description of Artificial Sequence: Synthetic oligonucleotide
  Target: ATXN1; (+) strand; PAM type: NNGRRT; PAM sequence: GGGGGT
gctcaaggatccgacttcat

SEQ ID NO: 25229 - DNA, 20 bp, Artificial Sequence
  Description of Artificial Sequence: Synthetic oligonucleotide
  Target: ATXN1; (+) strand; PAM type: NNGRRT; PAM sequence: AAGAGT
ggaggcgggcacctttccca

SEQ ID NO: 25230 - DNA, 20 bp, Artificial Sequence
  Description of Artificial Sequence: Synthetic oligonucleotide
  Target: ATXN1; (+) strand; PAM type: NNGRRT; PAM sequence: CGGGAT
acctttcccaaagagtggct

SEQ ID NO: 25231 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tcccaaagagtggctcggga

SEQ ID NO: 25232 - DNA, 20 bp, Artificial Sequence
  Description of Artificial Sequence: Synthetic oligonucleotide
  Target: ATXN1; (+) strand; PAM type: NNGRRT; PAM sequence: ACGGGT
atgaggtaatttgagcggtg

SEQ ID NO: 25233 - DNA, 20 bp, Artificial Sequence
  Description of Artificial Sequence: Synthetic oligonucleotide
  Target: ATXN1; (+) strand; PAM type: NNGRRT; PAM sequence: CTGGGT
gtcggtcctcgcgcgcctcc

SEQ ID NO: 25234 - DNA, 20 bp, Artificial Sequence
  Description of Artificial Sequence: Synthetic oligonucleotide
  Target: ATXN1; (+) strand; PAM type: NNGRRT; PAM sequence: GGGGAT
aacccaggcctgggggccgc

SEQ ID NO: 25235 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tgcaactccggaaagtttca

SEQ ID NO: 25236 - DNA, 20 bp, Artificial Sequence
  Description of Artificial Sequence: Synthetic oligonucleotide
  Target: ATXN1; (+) strand; PAM type: NNGRRT; PAM sequence: TCGGAT
cactcctctcgcagctaatt

SEQ ID NO: 25237 - DNA, 20 bp, Artificial Sequence
  Description of Artificial Sequence: Synthetic oligonucleotide
  Target: ATXN1; (+) strand; PAM type: NNGRRT; PAM sequence: GAGAAT
agcatcaaatggcagttctc

SEQ ID NO: 25238 - DNA, 20 bp, Artificial Sequence
  Description of Artificial Sequence: Synthetic oligonucleotide
  Target: ATXN1; (+) strand; PAM type: NNGRRT; PAM sequence: CAGGGT
gaggaacttaaatctggact

SEQ ID NO: 25239 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caggtgtgacctccacgcga

SEQ ID NO: 25240 - DNA, 20 bp, Artificial Sequence
  Description of Artificial Sequence: Synthetic oligonucleotide
  Target: ATXN1; (+) strand; PAM type: NNGRRT; PAM sequence: TCGGAT
tccacgcgaaggaatcttct

SEQ ID NO: 25241 - DNA, 20 bp, Artificial Sequence
  Description of Artificial Sequence: Synthetic oligonucleotide
  Target: ATXN1; (+) strand; PAM type: NNGRRT; PAM sequence: ATGGGT
cgcgaaggaatcttcttcgg

SEQ ID NO: 25242 - DNA, 20 bp, Artificial Sequence
  Description of Artificial Sequence: Synthetic oligonucleotide
  Target: ATXN1; (+) strand; PAM type: NNGRRT; PAM sequence: CTGAGT
gtatttgagagatcttttgg

SEQ ID NO: 25243 - DNA, 20 bp, Artificial Sequence
  Description of Artificial Sequence: Synthetic oligonucleotide
  Target: ATXN1; (+) strand; PAM type: NNGRRT; PAM sequence: CAGGAT
tcaccaactgaggcagggca

SEQ ID NO: 25244 - DNA, 20 bp, Artificial Sequence
  Description of Artificial Sequence: Synthetic oligonucleotide
  Target: ATXN1; (+) strand; PAM type: NNGRRT; PAM sequence: TCGGGT
ttattgttacggtttaaacc

SEQ ID NO: 25245 - DNA, 20 bp, Artificial Sequence
  Description of Artificial Sequence: Synthetic oligonucleotide
  Target: ATXN1; (+) strand; PAM type: NNGRRT; PAM sequence: CCGGGT
gttagtacgtaagagcataa

SEQ ID NO: 25246 - DNA, 20 bp, Artificial Sequence
  Description of Artificial Sequence: Synthetic oligonucleotide
  Target: ATXN1; (+) strand; PAM type: NNGRRT; PAM sequence: GTGAAT
ggtattattattactggact

SEQ ID NO: 25247 - DNA, 20 bp, Artificial Sequence
  Description of Artificial Sequence: Synthetic oligonucleotide
  Target: ATXN1; (+) strand; PAM type: NNGRRT; PAM sequence: CAGAGT
ttgggagctttttagacatt

SEQ ID NO: 25248 - DNA, 20 bp, Artificial Sequence
  Description of Artificial Sequence: Synthetic oligonucleotide
  Target: ATXN1; (+) strand; PAM type: NNGRRT; PAM sequence: AAGGGT
ctttttagacattcagagtc

SEQ ID NO: 25249 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ctaccccagacataccaaat

SEQ ID NO: 25250 - DNA, 20 bp, Artificial Sequence
  Description of Artificial Sequence: Synthetic oligonucleotide
  Target: ATXN1; (+) strand; PAM type: NNGRRT; PAM sequence: CTGGGT
tctgcctttgaaccaggccc

SEQ ID NO: 25251 - DNA, 20 bp, Artificial Sequence
  Description of Artificial Sequence: Synthetic oligonucleotide
  Target: ATXN1; (+) strand; PAM type: NNGRRT; PAM sequence: AGGGAT
agaacactggtctataccac

SEQ ID NO: 25252 - DNA, 20 bp, Artificial Sequence
  Description of Artificial Sequence: Synthetic oligonucleotide
  Target: ATXN1; (+) strand; PAM type: NNGRRT; PAM sequence: TTGGAT
aaattattatgttatatgct

SEQ ID NO: 25253 - DNA, 20 bp, Artificial Sequence
  Description of Artificial Sequence: Synthetic oligonucleotide
  Target: ATXN1; (+) strand; PAM type: NNGRRT; PAM sequence: AAGAAT
ctgcatcattattgccaaaa

SEQ ID NO: 25254 - DNA, 20 bp, Artificial Sequence
  Description of Artificial Sequence: Synthetic oligonucleotide
  Target: ATXN1; (+) strand; PAM type: NNGRRT; PAM sequence: AGGAAT
caaaaaagaatgctctgctg

SEQ ID NO: 25255 - DNA, 20 bp, Artificial Sequence
  Description of Artificial Sequence: Synthetic oligonucleotide
  Target: ATXN1; (+) strand; PAM type: NNGRRT; PAM sequence: TGGGGT
tgctctgctgaggaatgtac

SEQ ID NO: 25256 - DNA, 20 bp, Artificial Sequence
  Description of Artificial Sequence: Synthetic oligonucleotide
  Target: ATXN1; (+) strand; PAM type: NNGRRT; PAM sequence: AAGAGT
catggcagcagagggagcac

SEQ ID NO: 25257 - DNA, 20 bp, Artificial Sequence
  Description of Artificial Sequence: Synthetic oligonucleotide
  Target: ATXN1; (+) strand; PAM type: NNGRRT; PAM sequence: TTGAAT
gtaactgaacagattgaaag

SEQ ID NO: 25258 - DNA, 20 bp, Artificial Sequence
  Description of Artificial Sequence: Synthetic oligonucleotide
  Target: ATXN1; (+) strand; PAM type: NNGRRT; PAM sequence: TAGAGT
aaaataaagataaacttctt

SEQ ID NO: 25259 - DNA, 20 bp, Artificial Sequence
  Description of Artificial Sequence: Synthetic oligonucleotide
  Target: ATXN1; (+) strand; PAM type: NNGRRT; PAM sequence: TTGAAT
acttctttagagttttaggc

SEQ ID NO: 25260 - DNA, 20 bp, Artificial Sequence
  Description of Artificial Sequence: Synthetic oligonucleotide
  Target: ATXN1; (+) strand; PAM type: NNGRRT; PAM sequence: CAGAAT
aaaacaaagataacacaaca

SEQ ID NO: 25261 - DNA, 20 bp, Artificial Sequence
  Description of Artificial Sequence: Synthetic oligonucleotide
  Target: ATXN1; (+) strand; PAM type: NNGRRT; PAM sequence: CAGAAT
actcaaaaacaaagataaca

SEQ ID NO: 25262 - DNA, 20 bp, Artificial Sequence
  Description of Artificial Sequence: Synthetic oligonucleotide
  Target: ATXN1; (+) strand; PAM type: NNGRRT; PAM sequence: CAGAGT
agctcctgtttatctaaaaa

SEQ ID NO: 25263 - DNA, 20 bp, Artificial Sequence
  Description of Artificial Sequence: Synthetic oligonucleotide
  Target: ATXN1; (+) strand; PAM type: NNGRRT; PAM sequence: CAGAAT
ccttttgctgtgtttacact

SEQ ID NO: 25264 - DNA, 20 bp, Artificial Sequence
  Description of Artificial Sequence: Synthetic oligonucleotide
  Target: ATXN1; (+) strand; PAM type: NNGRRT; PAM sequence: AGGGGT
tttacactcagaataatttt

SEQ ID NO: 25265 - DNA, 20 bp, Artificial Sequence
  Description of Artificial Sequence: Synthetic oligonucleotide
  Target: ATXN1; (+) strand; PAM type: NNGRRT; PAM sequence: GAGGAT
tccttaatgcttgcagtggt

SEQ ID NO: 25266 - DNA, 20 bp, Artificial Sequence
  Description of Artificial Sequence: Synthetic oligonucleotide
  Target: ATXN1; (+) strand; PAM type: NNGRRT; PAM sequence: TTGAGT
cacatcgtgctttcataaca

SEQ ID NO: 25267 - DNA, 20 bp, Artificial Sequence
  Description of Artificial Sequence: Synthetic oligonucleotide
  Target: ATXN1; (+) strand; PAM type: NNGRRT; PAM sequence: GAGAAT
atctacaataactaagactt

SEQ ID NO: 25268 - DNA, 20 bp, Artificial Sequence
  Description of Artificial Sequence: Synthetic oligonucleotide
  Target: ATXN1; (+) strand; PAM type: NNGRRT; PAM sequence: TTGAGT
taagacttgagaatataaaa

SEQ ID NO: 25269 - DNA, 20 bp, Artificial Sequence
  Description of Artificial Sequence: Synthetic oligonucleotide
  Target: ATXN1; (+) strand; PAM type: NNGRRT; PAM sequence: CAGAAT
tgatgcgatccagcacctgc

SEQ ID NO: 25270 - DNA, 20 bp, Artificial Sequence
  Description of Artificial Sequence: Synthetic oligonucleotide
  Target: ATXN1; (+) strand; PAM type: NNGRRT; PAM sequence: GAGAAT
gcaatcagacttccaaatat

SEQ ID NO: 25271 - DNA, 20 bp, Artificial Sequence
  Description of Artificial Sequence: Synthetic oligonucleotide
  Target: ATXN1; (+) strand; PAM type: NNGRRT; PAM sequence: TAGAAT
caaatatgagaatcaaacat

SEQ ID NO: 25272 - DNA, 20 bp, Artificial Sequence
  Description of Artificial Sequence: Synthetic oligonucleotide
  Target: ATXN1; (+) strand; PAM type: NNGRRT; PAM sequence: TTGAAT
agatataatgtgtattttat

SEQ ID NO: 25273 - DNA, 20 bp, Artificial Sequence
  Description of Artificial Sequence: Synthetic oligonucleotide
  Target: ATXN1; (+) strand; PAM type: NNGRRT; PAM sequence: ATGAGT
cttccctatcacaaaatcac

SEQ ID NO: 25274 - DNA, 20 bp, Artificial Sequence
  Description of Artificial Sequence: Synthetic oligonucleotide
  Target: ATXN1; (+) strand; PAM type: NNGRRT; PAM sequence: TTGAGT
cacaaaatcacatgagtaag

SEQ ID NO: 25275 - DNA, 20 bp, Artificial Sequence
  Description of Artificial Sequence: Synthetic oligonucleotide
  Target: ATXN1; (+) strand; PAM type: NNGRRT; PAM sequence: AAGAAT
atcttttctaaaatgctgaa

SEQ ID NO: 25276 - DNA, 20 bp, Artificial Sequence
  Description of Artificial Sequence: Synthetic oligonucleotide
  Target: ATXN1; (+) strand; PAM type: NNGRRT; PAM sequence: GAGGGT
aatttttctcccacactaaa

SEQ ID NO: 25277 - DNA, 20 bp, Artificial Sequence
  Description of Artificial Sequence: Synthetic oligonucleotide
  Target: ATXN1; (+) strand; PAM type: NNGRRT; PAM sequence: TTGAAT
tgtaataaatcccagaaagt

SEQ ID NO: 25278 - DNA, 20 bp, Artificial Sequence
  Description of Artificial Sequence: Synthetic oligonucleotide
  Target: ATXN1; (+) strand; PAM type: NNGRRT; PAM sequence: CAGAAT
atttttaatggaaacactga

SEQ ID NO: 25279 - DNA, 20 bp, Artificial Sequence
  Description of Artificial Sequence: Synthetic oligonucleotide
  Target: ATXN1; (+) strand; PAM type: NNGRRT; PAM sequence: GAGGGT
ggaaacactgacagaataaa

SEQ ID NO: 25280 - DNA, 20 bp, Artificial Sequence
  Description of Artificial Sequence: Synthetic oligonucleotide
  Target: ATXN1; (+) strand; PAM type: NNGRRT; PAM sequence: CTGAAT
gactcttaaaagacatactt

SEQ ID NO: 25281 - DNA, 20 bp, Artificial Sequence
  Description of Artificial Sequence: Synthetic oligonucleotide
  Target: ATXN1; (+) strand; PAM type: NNGRRT; PAM sequence: GGGAAT
tgtagcaagacaggcttcct

SEQ ID NO: 25282 - DNA, 20 bp, Artificial Sequence
  Description of Artificial Sequence: Synthetic oligonucleotide
  Target: ATXN1; (+) strand; PAM type: NNGRRT; PAM sequence: AAGAGT
aaatgacattagcattagtc

SEQ ID NO: 25283 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
tgtcttagcaccagaggctt

SEQ ID NO: 25284 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
ccaagacctgtcttagcacc

SEQ ID NO: 25285 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
ttttgatagcctgcctgtct

SEQ ID NO: 25286 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
aggtgatttcattgaagtgg

SEQ ID NO: 25287 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
ttacgtggaaatcaccagca

SEQ ID NO: 25288 - DNA, 20 bp, Artificial Sequence
  Description of Artificial Sequence: Synthetic oligonucleotide
  Target: ATXN1; (-) strand; PAM type: NNNNGHTT; PAM sequence: ACCAGCTT
aaatggatagcgcaggtcct

SEQ ID NO: 25289 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
cgtcaacaacaggaaaagtc

SEQ ID NO: 25290 - DNA, 20 bp, Artificial Sequence
  Description of Artificial Sequence: Synthetic oligonucleotide
  Target: ATXN1; (-) strand; PAM type: NNNNGHTT; PAM sequence: GGCCGATT
aatgcccccagaatggccct

SEQ ID NO: 25291 - DNA, 20 bp, Artificial Sequence
  Description of Artificial Sequence: Synthetic oligonucleotide
  Target: ATXN1; (-) strand; PAM type: NNNNGHTT; PAM sequence: CCCTGCTT
ggagtcagggacccataaca

SEQ ID NO: 25292 - DNA, 20 bp, Artificial Sequence
  Description of Artificial Sequence: Synthetic oligonucleotide
  Target: ATXN1; (-) strand; PAM type: NNNNGHTT; PAM sequence: CAGCGCTT
gagaggaaagtcctggtgag

SEQ ID NO: 25293 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
cgatagaagttttcttttta

SEQ ID NO: 25294 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
cagaggctctggaagacgat

SEQ ID NO: 25295 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
tcccccgagaatatccagga

SEQ ID NO: 25296 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
ttgccctcctgctgagctcc

SEQ ID NO: 25297 - DNA, 20 bp, Artificial Sequence
  Description of Artificial Sequence: Synthetic oligonucleotide
  Target: ATXN1; (-) strand; PAM type: NNNNGHTT; PAM sequence: CGCTGCTT
acgcttccactcgagccaga

SEQ ID NO: 25298 - DNA, 20 bp, Artificial Sequence
  Description of Artificial Sequence: Synthetic oligonucleotide
  Target: ATXN1; (-) strand; PAM type: NNNNGHTT; PAM sequence: GGACGCTT
gagatgggaaaagcaggttt

SEQ ID NO: 25299 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
cttggggggagatgggaaaa

SEQ ID NO: 25300 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
aaaaagagaaaggtgcaagt

SEQ ID NO: 25301 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
cttgtctgctaatcgccggg

SEQ ID NO: 25302 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
tcatgttcatctgtccagtt

SEQ ID NO: 25303 - DNA, 20 bp, Artificial Sequence
  Description of Artificial Sequence: Synthetic oligonucleotide
  Target: ATXN1; (-) strand; PAM type: NNNNGHTT; PAM sequence: GACAGCTT
aaatgagaagccaggacagg

SEQ ID NO: 25304 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
ccttttaggatgccactgat

SEQ ID NO: 25305 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
tgccatgtggtccttccgag

SEQ ID NO: 25306 - DNA, 20 bp, Artificial Sequence
  Description of Artificial Sequence: Synthetic oligonucleotide
  Target: ATXN1; (-) strand; PAM type: NNNNGHTT; PAM sequence: CACTGTTT
gtcatcacttcttctgcgtt

SEQ ID NO: 25307 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
aggcctggaactcaatactt

SEQ ID NO: 25308 - DNA, 20 bp, Artificial Sequence
  Description of Artificial Sequence: Synthetic oligonucleotide
  Target: ATXN1; (-) strand; PAM type: NNNNGHTT; PAM sequence: ATACGCTT
agtaaaacaacctgatctgc

SEQ ID NO: 25309 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
gatcttctctactccagggt

SEQ ID NO: 25310 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
aaaaaaaaaaaaaaactctt

SEQ ID NO: 25311 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
caggtggatggcttgagccc

SEQ ID NO: 25312 - DNA, 20 bp, Artificial Sequence
  Description of Artificial Sequence: Synthetic oligonucleotide
  Target: ATXN1; (-) strand; PAM type: NNNNGHTT; PAM sequence: GATGGCTT
tggggaggttgacgcaggtg

SEQ ID NO: 25313 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
ccgtctccaaagtgcagccc

SEQ ID NO: 25314 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
tcaaaatggtcctaacgagt

SEQ ID NO: 25315 - DNA, 20 bp, Artificial Sequence
  Description of Artificial Sequence: Synthetic oligonucleotide
  Target: ATXN1; (-) strand; PAM type: NNNNGHTT; PAM sequence: ACGAGTTT
tctgcttcaaaatggtccta

SEQ ID NO: 25316 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
agacattctctttctgaagg

SEQ ID NO: 25317 - DNA, 20 bp, Artificial Sequence
  Description of Artificial Sequence: Synthetic oligonucleotide
  Target: ATXN1; (-) strand; PAM type: NNNNGHTT; PAM sequence: CCGAGATT
gaggcggaggttgcagtgag

SEQ ID NO: 25318 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgggtggatcacccgagccc

SEQ ID NO: 25319 - DNA, 20 bp, Artificial Sequence
  Description of Artificial Sequence: Synthetic oligonucleotide
  Target: ATXN1; (-) strand; PAM type: NNNNGHTT; PAM sequence: GCATGCTT
agtgggtcagcagcaaagct

SEQ ID NO: 25320 - DNA, 20 bp, Artificial Sequence
  Description of Artificial Sequence: Synthetic oligonucleotide
  Target: ATXN1; (-) strand; PAM type: NNNNGHTT; PAM sequence: ACAAGTTT
gtgagatactgattgttctg

SEQ ID NO: 25321 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
ccctttttgtttgtgtgaga

SEQ ID NO: 25322 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tctgcatctctgccttccct

SEQ ID NO: 25323 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
ggaaggtgttttggactctc

SEQ ID NO: 25324 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
gaggaactatcttcttggga

SEQ ID NO: 25325 - DNA, 20 bp, Artificial Sequence
  Description of Artificial Sequence: Synthetic oligonucleotide
  Target: ATXN1; (-) strand; PAM type: NNNNGHTT; PAM sequence: GAACGCTT
aaggttacacagaggtggga

SEQ ID NO: 25326 - DNA, 20 bp, Artificial Sequence
  Description of Artificial Sequence: Synthetic oligonucleotide
  Target: ATXN1; (-) strand; PAM type: NNNNGHTT; PAM sequence: CATAGCTT
aaagtaattcctcaagaacc

SEQ ID NO: 25327 - DNA, 20 bp, Artificial Sequence
  Description of Artificial Sequence: Synthetic oligonucleotide
  Target: ATXN1; (-) strand; PAM type: NNNNGHTT; PAM sequence: TATGGCTT
tgggcccagtcttggaaaga

SEQ ID NO: 25328 - DNA, 20 bp, Artificial Sequence
  Description of Artificial Sequence: Synthetic oligonucleotide
  Target: ATXN1; (-) strand; PAM type: NNNNGHTT; PAM sequence: TACAGCTT
ttacctcaagagtaccacat

SEQ ID NO: 25329 - DNA, 20 bp, Artificial Sequence
  Description of Artificial Sequence: Synthetic oligonucleotide
  Target: ATXN1; (-) strand; PAM type: NNNNGHTT; PAM sequence: CCCCGTTT
tctcagcatgtggaggaact

SEQ ID NO: 25330 - DNA, 20 bp, Artificial Sequence
  Description of Artificial Sequence: Synthetic oligonucleotide
  Target: ATXN1; (-) strand; PAM type: NNNNGHTT; PAM sequence: GCCTGCTT
tggggaggccgaggcacaag

SEQ ID NO: 25331 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
ggcataatctatacactcct

SEQ ID NO: 25332 - DNA, 20 bp, Artificial Sequence
  Description of Artificial Sequence: Synthetic oligonucleotide
  Target: ATXN1; (-) strand; PAM type: NNNNGHTT; PAM sequence: GGTAGCTT
atacttgtctttaaacatgt

SEQ ID NO: 25333 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
gatgtcttggtttcttcagt

SEQ ID NO: 25334 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
cacacagccacacctgatgt

SEQ ID NO: 25335 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
tgaggcattgccttcgctgc

SEQ ID NO: 25336 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
tctgtataccagtacaagtt

SEQ ID NO: 25337 - DNA, 20 bp, Artificial Sequence
  Description of Artificial Sequence: Synthetic oligonucleotide
  Target: ATXN1; (-) strand; PAM type: NNNNGHTT; PAM sequence: ACAAGTTT
taaattgtctgtataccagt

SEQ ID NO: 25338 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
ttgattcaaaatttgaacaa

SEQ ID NO: 25339 - DNA, 20 bp, Artificial Sequence
  Description of Artificial Sequence: Synthetic oligonucleotide
  Target: ATXN1; (-) strand; PAM type: NNNNGHTT; PAM sequence: GTTTGATT
cattattataataaaacaat

SEQ ID NO: 25340 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
atttcattattataataaaa

SEQ ID NO: 25341 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
ccctttctttgatggtgctt

SEQ ID NO: 25342 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
tttatggtccctttctttga

SEQ ID NO: 25343 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
tatttgtaggatacactcga

SEQ ID NO: 25344 - DNA, 20 bp, Artificial Sequence
  Description of Artificial Sequence: Synthetic oligonucleotide
  Target: ATXN1; (-) strand; PAM type: NNNNGHTT; PAM sequence: ACTAGCTT
gtgtaaaatattgtacttgc

SEQ ID NO: 25345 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
taagtgcatacataatagtt

SEQ ID NO: 25346 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
gaggagaactagggaaggaa

SEQ ID NO: 25347 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
tctctgagactcgtactact

SEQ ID NO: 25348 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
tgtcagtatttgtggtgacc

SEQ ID NO: 25349 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
caaattagtgtcagccgaaa

SEQ ID NO: 25350 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
gtgaatactgccctttttgg

SEQ ID NO: 25351 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
ttacaggaaccacctactct

SEQ ID NO: 25352 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
gttaccaagaagctcggtgc

SEQ ID NO: 25353 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
ctgaaggccttcgttggaag

SEQ ID NO: 25354 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
ccacgttttctttcccttta

SEQ ID NO: 25355 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
tcacccacgttttctttccc

SEQ ID NO: 25356 - DNA, 20 bp, Artificial Sequence
  Description of Artificial Sequence: Synthetic oligonucleotide
  Target: ATXN1; (-) strand; PAM type: NNNNGHTT; PAM sequence: CCACGTTT
agatacattggaggcttcac

SEQ ID NO: 25357 - DNA, 20 bp, Artificial Sequence
  Description of Artificial Sequence: Synthetic oligonucleotide
  Target: ATXN1; (-) strand; PAM type: NNNNGHTT; PAM sequence: GGAGGCTT
tcttccactgcagatacatt

SEQ ID NO: 25358 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
tggcgggagggaacaccggc

SEQ ID NO: 25359 - DNA, 20 bp, Artificial Sequence
  Description of Artificial Sequence: Synthetic oligonucleotide
  Target: ATXN1; (-) strand; PAM type: NNNNGHTT; PAM sequence: ACCGGCTT
gtgtaatggcgggagggaac

SEQ ID NO: 25360 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
ctcattttattttagtttta

SEQ ID NO: 25361 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
atgtaaatgcctcattttat

SEQ ID NO: 25362 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
tttaaatggggggagtaaaa

SEQ ID NO: 25363 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
agaatataatcttgaacacg

SEQ ID NO: 25364 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
aacttctttttcttcagaga

SEQ ID NO: 25365 - DNA, 20 bp, Artificial Sequence
  Description of Artificial Sequence: Synthetic oligonucleotide
  Target: ATXN1; (-) strand; PAM type: NNNNGHTT; PAM sequence: CTGCGATT
agggaggggaactcggtatt

SEQ ID NO: 25366 - DNA, 20 bp, Artificial Sequence
  Description of Artificial Sequence: Synthetic oligonucleotide
  Target: ATXN1; (-) strand; PAM type: NNNNGHTT; PAM sequence: CTATGCTT
aaaaggctcttaaactatac

SEQ ID NO: 25367 - DNA, 20 bp, Artificial Sequence
  Description of Artificial Sequence: Synthetic oligonucleotide
  Target: ATXN1; (-) strand; PAM type: NNNNGHTT; PAM sequence: ATCAGATT
aaatttgtcatgtctaaatg

SEQ ID NO: 25368 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
gcagagaagggttgaaagtt

SEQ ID NO: 25369 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
ttgaaacaatgagtttcata

SEQ ID NO: 25370 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
gatatggctctgttgaaaca

SEQ ID NO: 25371 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
gaatgtcgaaatgattcatt

SEQ ID NO: 25372 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
caaaagaaaaatgaatgtcg

SEQ ID NO: 25373 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
ctcactttgaggagtacagg

SEQ ID NO: 25374 - DNA, 20 bp, Artificial Sequence
  Description of Artificial Sequence: Synthetic oligonucleotide
  Target: ATXN1; (-) strand; PAM type: NNNNGHTT; PAM sequence: ACCTGATT
gaatttttttttaaatgtac

SEQ ID NO: 25375 - DNA, 20 bp, Artificial Sequence
  Description of Artificial Sequence: Synthetic oligonucleotide
  Target: ATXN1; (-) strand; PAM type: NNNNGHTT; PAM sequence: CCTCGCTT
gatttcttttacatagatga

SEQ ID NO: 25376 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tgcacacctctactccggag

SEQ ID NO: 25377 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
tctcttttccacggacagtg

SEQ ID NO: 25378 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
tgcatctgctattgtgttgg

SEQ ID NO: 25379 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
gtggaggcctttgcttccac

SEQ ID NO: 25380 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
tttttaagtggcgtggaggc

SEQ ID NO: 25381 - DNA, 20 bp, Artificial Sequence
  Description of Artificial Sequence: Synthetic oligonucleotide
  Target: ATXN1; (-) strand; PAM type: NNNNGHTT; PAM sequence: TTCGGTTT
cagcagactccatggcccaa

SEQ ID NO: 25382 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
gctgtgttggttgtcatggc

SEQ ID NO: 25383 - DNA, 20 bp, Artificial Sequence
  Description of Artificial Sequence: Synthetic oligonucleotide
  Target: ATXN1; (-) strand; PAM type: NNNNGHTT; PAM sequence: CCGGGCTT
agagctctcggtaccgaagg

SEQ ID NO: 25384 - DNA, 20 bp, Artificial Sequence
  Description of Artificial Sequence: Synthetic oligonucleotide
  Target: ATXN1; (-) strand; PAM type: NNNNGHTT; PAM sequence: CAATGCTT
ttcatagagagaaaaatctc

SEQ ID NO: 25385 - DNA, 20 bp, Artificial Sequence
  Description of Artificial Sequence: Synthetic oligonucleotide
  Target: ATXN1; (-) strand; PAM type: NNNNGHTT; PAM sequence: AAACGATT
ttttgttttgttttttaagg

SEQ ID NO: 25386 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tagctctggattttgttttg

SEQ ID NO: 25387 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tgttgtagctctggattttg

SEQ ID NO: 25388 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tttgttgttgtagctctgga

SEQ ID NO: 25389 - DNA, 20 bp, Artificial Sequence
  Description of Artificial Sequence: Synthetic oligonucleotide
  Target: ATXN1; (-) strand; PAM type: NNNNGHTT; PAM sequence: TCTGGATT
tttatttttgttgttgtagc

SEQ ID NO: 25390 - DNA, 20 bp, Artificial Sequence
  Description of Artificial Sequence: Synthetic oligonucleotide
  Target: ATXN1; (-) strand; PAM type: NNNNGHTT; PAM sequence: CACAGTTT
atcataaaatccactctttg

SEQ ID NO: 25391 - DNA, 20 bp, Artificial Sequence
  Description of Artificial Sequence: Synthetic oligonucleotide
  Target: ATXN1; (-) strand; PAM type: NNNNGHTT; PAM sequence: CATAGATT
ggattactccttagataccg

SEQ ID NO: 25392 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
tgtttggatttcctgcatct

SEQ ID NO: 25393 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
ttgtacaatttcaaggaatg

SEQ ID NO: 25394 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
tagggttgtacaatttcaag

SEQ ID NO: 25395 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
ttttctgttaggtgagtgtg

SEQ ID NO: 25396 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
taacttggaattgtgagcct

SEQ ID NO: 25397 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
acccagtttagtttgggatg

SEQ ID NO: 25398 - DNA, 20 bp, Artificial Sequence
  Description of Artificial Sequence: Synthetic oligonucleotide
  Target: ATXN1; (-) strand; PAM type: NNNNGHTT; PAM sequence: GGATGATT
aactcacccagtttagtttg

SEQ ID NO: 25399 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
gttttccctaactcacccag

SEQ ID NO: 25400 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
ttttcgttttccctaactca

SEQ ID NO: 25401 - DNA, 20 bp, Artificial Sequence
  Description of Artificial Sequence: Synthetic oligonucleotide
  Target: ATXN1; (-) strand; PAM type: NNNNGHTT; PAM sequence: TTTCGTTT
attttctatgttggtcaact

SEQ ID NO: 25402 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
atgtttaacttaagaattat

SEQ ID NO: 25403 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
tataaaatgactgttcctta

SEQ ID NO: 25404 - DNA, 20 bp, Artificial Sequence
  Description of Artificial Sequence: Synthetic oligonucleotide
  Target: ATXN1; (-) strand; PAM type: NNNNGHTT; PAM sequence: TAGGGATT
caaacaagaacctctctttc

SEQ ID NO: 25405 - DNA, 20 bp, Artificial Sequence
  Description of Artificial Sequence: Synthetic oligonucleotide
  Target: ATXN1; (-) strand; PAM type: NNNNGHTT; PAM sequence: TTGCGTTT
aactagtaacagcaggcctt

SEQ ID NO: 25406 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
gccgtcttttgttctttctt

SEQ ID NO: 25407 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
gtagaaattcttcggtgccg

SEQ ID NO: 25408 - DNA, 20 bp, Artificial Sequence
  Description of Artificial Sequence: Synthetic oligonucleotide
  Target: ATXN1; (-) strand; PAM type: NNNNGHTT; PAM sequence: CACCGCTT
gctcccagagcagcctctgt

SEQ ID NO: 25409 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
acgcacagagggcaggagcc

SEQ ID NO: 25410 - DNA, 20 bp, Artificial Sequence
  Description of Artificial Sequence: Synthetic oligonucleotide
  Target: ATXN1; (-) strand; PAM type: NNNNGHTT; PAM sequence: GGCAGCTT
cacggtcaccactcccttgt

SEQ ID NO: 25411 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
tggagtgtggagaggaagga

SEQ ID NO: 25412 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
tcattcccttttggcttttt

SEQ ID NO: 25413 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
atagttaaagctcattccct

SEQ ID NO: 25414 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
acacttgtcccatttcattc

SEQ ID NO: 25415 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
cactaagatgggaaaacaca

SEQ ID NO: 25416 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
cagaaaaacacacaccacct

SEQ ID NO: 25417 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ttattaggttttgtttttct

SEQ ID NO: 25418 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gggcacttgcaattattagg

SEQ ID NO: 25419 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
gctcagggcacttgcaatta

SEQ ID NO: 25420 - DNA, 20 bp, Artificial Sequence
  Description of Artificial Sequence: Synthetic oligonucleotide
  Target: ATXN1; (-) strand; PAM type: NNNNGHTT; PAM sequence: ACTTGCTT
taaacgtttctgttcagaga

SEQ ID NO: 25421 - DNA, 20 bp, Artificial Sequence
  Description of Artificial Sequence: Synthetic oligonucleotide
  Target: ATXN1; (-) strand; PAM type: NNNNGHTT; PAM sequence: AAACGTTT
tatttagtgctgtatttttt

SEQ ID NO: 25422 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
tgggctcattcttgcagtca

SEQ ID NO: 25423 - DNA, 20 bp, Artificial Sequence
  Description of Artificial Sequence: Synthetic oligonucleotide
  Target: ATXN1; (-) strand; PAM type: NNNNGHTT; PAM sequence: GCATGCTT
cgaatttcattaccctctca

SEQ ID NO: 25424 - DNA, 20 bp, Artificial Sequence
  Description of Artificial Sequence: Synthetic oligonucleotide
  Target: ATXN1; (-) strand; PAM type: NNNNGHTT; PAM sequence: ATAGGTTT
ggtgtaccaaaaacatttga

SEQ ID NO: 25425 - DNA, 20 bp, Artificial Sequence
  Description of Artificial Sequence: Synthetic oligonucleotide
  Target: ATXN1; (-) strand; PAM type: NNNNGHTT; PAM sequence: AACCGTTT
caggactaatgatttttata

SEQ ID NO: 25426 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
catttagggttcaccaggac

SEQ ID NO: 25427 - DNA, 20 bp, Artificial Sequence
  Description of Artificial Sequence: Synthetic oligonucleotide
  Target: ATXN1; (-) strand; PAM type: NNNNGHTT; PAM sequence: CTTCGTTT
cccattgaaaatagtacttt

SEQ ID NO: 25428 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
atctttaaagtgctttaaaa

SEQ ID NO: 25429 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
gggttttgaatgcatcttta

SEQ ID NO: 25430 - DNA, 20 bp, Artificial Sequence
  Description of Artificial Sequence: Synthetic oligonucleotide
  Target: ATXN1; (-) strand; PAM type: NNNNGHTT; PAM sequence: GTGGGTTT
agagatccgaaatatcattt

SEQ ID NO: 25431 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
caaacccagaaagggtattt

SEQ ID NO: 25432 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
ttcaaaatcaaatcgagatt

SEQ ID NO: 25433 - DNA, 20 bp, Artificial Sequence
  Description of Artificial Sequence: Synthetic oligonucleotide
  Target: ATXN1; (-) strand; PAM type: NNNNGHTT; PAM sequence: TCGAGATT
tttttctattcaaaatcaaa

SEQ ID NO: 25434 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
gttattaatgttattttcag

SEQ ID NO: 25435 - DNA, 20 bp, Artificial Sequence
  Description of Artificial Sequence: Synthetic oligonucleotide
  Target: ATXN1; (-) strand; PAM type: NNNNGHTT; PAM sequence: GCAAGATT
aaagacatttatatatgtga

SEQ ID NO: 25436 - DNA, 20 bp, Artificial Sequence
  Description of Artificial Sequence: Synthetic oligonucleotide
  Target: ATXN1; (-) strand; PAM type: NNNNGHTT; PAM sequence: GAGAGTTT
attttcttcagattcattga

SEQ ID NO: 25437 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
tagaaactctgagaattttc

SEQ ID NO: 25438 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
ttatccaataacattgtggg

SEQ ID NO: 25439 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
tataacttgtgtgatattcc

SEQ ID NO: 25440 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
aaccttgcgatttgcacata

SEQ ID NO: 25441 - DNA, 20 bp, Artificial Sequence
  Description of Artificial Sequence: Synthetic oligonucleotide
  Target: ATXN1; (-) strand; PAM type: NNNNGHTT; PAM sequence: TTGCGATT
agatgaacttttaaagaacc

SEQ ID NO: 25442 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
agagaatactcatttttgtc

SEQ ID NO: 25443 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
caagatattgaaagtttcaa

SEQ ID NO: 25444 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
ttgctgaagagcaagatatt

SEQ ID NO: 25445 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
aacaaaaacaaaaaaaacta

SEQ ID NO: 25446 - DNA, 20 bp, Artificial Sequence
  Description of Artificial Sequence: Synthetic oligonucleotide
  Target: ATXN1; (-) strand; PAM type: NNNNGHTT; PAM sequence: ATTAGATT
attccagtgtgacatgagga

SEQ ID NO: 25447 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
gggtgccacttttttttttt

SEQ ID NO: 25448 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
tttttgtctttgaactctag

SEQ ID NO: 25449 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
agcaacagaagctcttcacg

SEQ ID NO: 25450 - DNA, 20 bp, Artificial Sequence
  Description of Artificial Sequence: Synthetic oligonucleotide
  Target: ATXN1; (-) strand; PAM type: NNNNGHTT; PAM sequence: GCTGGTTT
gggagagagcgaacacccac

SEQ ID NO: 25451 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
tgccacatgcgggatttcat

SEQ ID NO: 25452 - DNA, 20 bp, Artificial Sequence
  Description of Artificial Sequence: Synthetic oligonucleotide
  Target: ATXN1; (-) strand; PAM type: NNNNGHTT; PAM sequence: GCGGGATT
ttaaagagcaactgccacat

SEQ ID NO: 25453 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
atcgcggagacgcgtcagat

SEQ ID NO: 25454 - DNA, 20 bp, Artificial Sequence
  Description of Artificial Sequence: Synthetic oligonucleotide
  Target: ATXN1; (-) strand; PAM type: NNNNGHTT; PAM sequence: CCCAGCTT
tgcaaaatcaacatcaggaa

SEQ ID NO: 25455 - DNA, 20 bp, Artificial Sequence
  Description of Artificial Sequence: Synthetic oligonucleotide
  Target: ATXN1; (-) strand; PAM type: NNNNGHTT; PAM sequence: CGGGGCTT
atccccggggaagaaaggaa

SEQ ID NO: 25456 - DNA, 20 bp, Artificial Sequence
  Description of Artificial Sequence: Synthetic oligonucleotide
  Target: ATXN1; (-) strand; PAM type: NNNNGHTT; PAM sequence: ATATGCTT
gtgtcgcaggagactggtgc

SEQ ID NO: 25457 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
tacatgttatcttcttaatt

SEQ ID NO: 25458 - DNA, 20 bp, Artificial Sequence
  Description of Artificial Sequence: Synthetic oligonucleotide
  Target: ATXN1; (-) strand; PAM type: NNNNGHTT; PAM sequence: TCCAGATT
gctctcccttatcatttgta

SEQ ID NO: 25459 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
ttctctaattcctcaggagg

SEQ ID NO: 25460 - DNA, 20 bp, Artificial Sequence
  Description of Artificial Sequence: Synthetic oligonucleotide
  Target: ATXN1; (-) strand; PAM type: NNNNGHTT; PAM sequence: ATGGGATT
aactgaagtttccagagaaa

SEQ ID NO: 25461 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
gctctctgagaatggcgaac

SEQ ID NO: 25462 - DNA, 20 bp, Artificial Sequence
  Description of Artificial Sequence: Synthetic oligonucleotide
  Target: ATXN1; (-) strand; PAM type: NNNNGHTT; PAM sequence: TCTCGCTT
ctcagttggggatgtctgca

SEQ ID NO: 25463 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
ccggagagaaccagccagct

SEQ ID NO: 25464 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
tttggtagagtatccttttt

SEQ ID NO: 25465 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
ctgtttccacaggtcagcgt

SEQ ID NO: 25466 - DNA, 20 bp, Artificial Sequence
  Description of Artificial Sequence: Synthetic oligonucleotide
  Target: ATXN1; (-) strand; PAM type: NNNNGHTT; PAM sequence: CCCTGTTT
ttcttcctctctctgtctct

SEQ ID NO: 25467 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
cataaaatcaaacaagaata

SEQ ID NO: 25468 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
agtgtgtggctgggggagag

SEQ ID NO: 25469 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
tgaatattgatgaccttttc

SEQ ID NO: 25470 - DNA, 20 bp, Artificial Sequence
  Description of Artificial Sequence: Synthetic oligonucleotide
  Target: ATXN1; (-) strand; PAM type: NNNNGHTT; PAM sequence: GTTCGATT
ggtgctctgtcattactggg

SEQ ID NO: 25471 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
cttgtgagccacctgcagag

SEQ ID NO: 25472 - DNA, 20 bp, Artificial Sequence
  Description of Artificial Sequence: Synthetic oligonucleotide
  Target: ATXN1; (-) strand; PAM type: NNNNGHTT; PAM sequence: CTGGGCTT
tcataaaatctaagaccgcg

SEQ ID NO: 25473 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
actcacagtctcactctgat

SEQ ID NO: 25474 - DNA, 20 bp, Artificial Sequence
  Description of Artificial Sequence: Synthetic oligonucleotide
  Target: ATXN1; (-) strand; PAM type: NNNNGHTT; PAM sequence: GCCTGCTT
ctcagtgataaacacactgt

SEQ ID NO: 25475 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
caccttggtgtcccaaagtg

SEQ ID NO: 25476 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttttatttttagtggaga

SEQ ID NO: 25477 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgtttcagcctcccaagtag

SEQ ID NO: 25478 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
ctcctgggttcaagtgattc

SEQ ID NO: 25479 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacatctgcctcctgggttc

SEQ ID NO: 25480 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
tgtttgcttatatttttgtt

SEQ ID NO: 25481 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
cagagtttttaaatttattt

SEQ ID NO: 25482 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tgtccagagtttttaaattt

SEQ ID NO: 25483 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
aaaagtttaaacattttgtc

SEQ ID NO: 25484 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
ctgtccagtactataagaaa

SEQ ID NO: 25485 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgccttggcctcccaaagtg

SEQ ID NO: 25486 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttagtagaga

SEQ ID NO: 25487 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
gggcccaccaccacacctgg

SEQ ID NO: 25488 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcctgagtag

SEQ ID NO: 25489 - DNA, 20 bp, Artificial Sequence
  Description of Artificial Sequence: Synthetic oligonucleotide
  Target: ATXN1; (-) strand; PAM type: NNNNGHTT; PAM sequence: AAACGATT
aaccttcgtcccccggactc

SEQ ID NO: 25490 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtatttttagtaggga

SEQ ID NO: 25491 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcctgagtag

SEQ ID NO: 25492 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
agcctccgcctcccgggttc

SEQ ID NO: 25493 - DNA, 20 bp, Artificial Sequence
  Description of Artificial Sequence: Synthetic oligonucleotide
  Target: ATXN1; (-) strand; PAM type: NNNNGHTT; PAM sequence: CGGAGTTT
gtgtgtgtgtgtgtgtgtga

SEQ ID NO: 25494 - DNA, 20 bp, Artificial Sequence
  Description of Artificial Sequence: Synthetic oligonucleotide
  Target: ATXN1; (-) strand; PAM type: NNNNGHTT; PAM sequence: ACCAGCTT
ggagaaaacaggcccccaac

SEQ ID NO: 25495 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
ttaacactatcaaaagccca

SEQ ID NO: 25496 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
tcactgtctcctctaaggga

SEQ ID NO: 25497 - DNA, 20 bp, Artificial Sequence
  Description of Artificial Sequence: Synthetic oligonucleotide
  Target: ATXN1; (-) strand; PAM type: NNNNGHTT; PAM sequence: GTTGGCTT
cttcagaccttgaaaggcct

SEQ ID NO: 25498 - DNA, 20 bp, Artificial Sequence
  Description of Artificial Sequence: Synthetic oligonucleotide
  Target: ATXN1; (-) strand; PAM type: NNNNGHTT; PAM sequence: CTGAGCTT
agggactcagatgagtcaat

SEQ ID NO: 25499 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
aaagtaattcaagaccttaa

SEQ ID NO: 25500 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
ccaccccccttttttaaatt

SEQ ID NO: 25501 - DNA, 20 bp, Artificial Sequence
  Description of Artificial Sequence: Synthetic oligonucleotide
  Target: ATXN1; (-) strand; PAM type: NNNNGHTT; PAM sequence: TAGTGCTT
tttaagatctgatattttgc

SEQ ID NO: 25502 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
tggatcttttaaaaacagat

SEQ ID NO: 25503 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
ggcttcatggatcttttaaa

SEQ ID NO: 25504 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
tacaggcatgagccaccatg

SEQ ID NO: 25505 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tgtctcagcctcccaaagta

SEQ ID NO: 25506 - DNA, 20 bp, Artificial Sequence
  Description of Artificial Sequence: Synthetic oligonucleotide
  Target: ATXN1; (-) strand; PAM type: NNNNGHTT; PAM sequence: TCTTGATT
aactggaaagctcattgcat

SEQ ID NO: 25507 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
atctccctctcttcctcctc

SEQ ID NO: 25508 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
aaactgtcttattatccttc

SEQ ID NO: 25509 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
gatttctttttgtttatttt

SEQ ID NO: 25510 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ctgcctcagtgaggatttct

SEQ ID NO: 25511 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
ttaattctcatctgcctcag

SEQ ID NO: 25512 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
acaagatgtctttgatttat

SEQ ID NO: 25513 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
ctgtttagtttacaagatgt

SEQ ID NO: 25514 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
tttaacgatattttttcctg

SEQ ID NO: 25515 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
aggcttttaacgatattttt

SEQ ID NO: 25516 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
caccacacccagcctgttct

SEQ ID NO: 25517 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cacctcggcctcccaaagtg

SEQ ID NO: 25518 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgcatttttagtagaga

SEQ ID NO: 25519 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagccccccgagtag

SEQ ID NO: 25520 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctccgcctcccgggttc

SEQ ID NO: 25521 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
tagaggctttttttttttaa

SEQ ID NO: 25522 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
gataatatgtattttgttct

SEQ ID NO: 25523 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
atgtaaactgtgagttccat

SEQ ID NO: 25524 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
ttccattgtctccattgtct

SEQ ID NO: 25525 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
tgatggtgaattcttttaat

SEQ ID NO: 25526 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
ctgtacaaacttcaatctag

SEQ ID NO: 25527 - DNA, 20 bp, Artificial Sequence
  Description of Artificial Sequence: Synthetic oligonucleotide
  Target: ATXN1; (-) strand; PAM type: NNNNGHTT; PAM sequence: TCTAGATT
cctccctgtacaaacttcaa

SEQ ID NO: 25528 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
ttacatatagccaatattca

SEQ ID NO: 25529 - DNA, 20 bp, Artificial Sequence
  Description of Artificial Sequence: Synthetic oligonucleotide
  Target: ATXN1; (-) strand; PAM type: NNNNGHTT; PAM sequence: CGGAGATT
actcgcttgaacccgggagg

SEQ ID NO: 25530 - DNA, 20 bp, Artificial Sequence
  Description of Artificial Sequence: Synthetic oligonucleotide
  Target: ATXN1; (-) strand; PAM type: NNNNGHTT; PAM sequence: ACTCGCTT
ttgggagtctgaggcaggag

SEQ ID NO: 25531 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
ttggtacttcaattatgcat

SEQ ID NO: 25532 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
ctgtggaaatctactacttt

SEQ ID NO: 25533 - DNA, 20 bp, Artificial Sequence
  Description of Artificial Sequence: Synthetic oligonucleotide
  Target: ATXN1; (-) strand; PAM type: NNNNGHTT; PAM sequence: TCATGCTT
atacacacaggagaaggggt

SEQ ID NO: 25534 - DNA, 20 bp, Artificial Sequence
  Description of Artificial Sequence: Synthetic oligonucleotide
  Target: ATXN1; (-) strand; PAM type: NNNNGHTT; PAM sequence: GCTTGCTT
taggcactcaaaaactttta

SEQ ID NO: 25535 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
agagtaggcactcaaaaact

SEQ ID NO: 25536 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
tttttgtaaagtttgtacct

SEQ ID NO: 25537 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
attaaacaaaatactttttg

SEQ ID NO: 25538 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
ggaggcacagaaaaaagaaa

SEQ ID NO: 25539 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
ccactgttggggggtagcag

SEQ ID NO: 25540 - DNA, 20 bp, Artificial Sequence
  Description of Artificial Sequence: Synthetic oligonucleotide
  Target: ATXN1; (-) strand; PAM type: NNNNGHTT; PAM sequence: TGTAGTTT
gtttctgtgtgtgatgtaaa

SEQ ID NO: 25541 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
gtctatgtatatatgcacat

SEQ ID NO: 25542 - DNA, 20 bp, Artificial Sequence
  Description of Artificial Sequence: Synthetic oligonucleotide
  Target: ATXN1; (-) strand; PAM type: NNNNGHTT; PAM sequence: TCCAGATT
agaggatctatggagccagt

SEQ ID NO: 25543 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
ttatgttgttaatgactcta

SEQ ID NO: 25544 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gtgggattggtttccttctg

SEQ ID NO: 25545 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
caatctccacttgatgtggg

SEQ ID NO: 25546 - DNA, 20 bp, Artificial Sequence
  Description of Artificial Sequence: Synthetic oligonucleotide
  Target: ATXN1; (-) strand; PAM type: NNNNGHTT; PAM sequence: GTGGGATT
caaaacaatctccacttgat

SEQ ID NO: 25547 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
tgagagttttatttttatga

SEQ ID NO: 25548 - DNA, 20 bp, Artificial Sequence
  Description of Artificial Sequence: Synthetic oligonucleotide
  Target: ATXN1; (-) strand; PAM type: NNNNGHTT; PAM sequence: GAGAGTTT
cgagacagatgttaacacct

SEQ ID NO: 25549 - DNA, 20 bp, Artificial Sequence
  Description of Artificial Sequence: Synthetic oligonucleotide
  Target: ATXN1; (-) strand; PAM type: NNNNGHTT; PAM sequence: TAAGGCTT
gaggctgacatgtttggaac

SEQ ID NO: 25550 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
cagaaccagaaaagaggctg

SEQ ID NO: 25551 - DNA, 20 bp, Artificial Sequence
  Description of Artificial Sequence: Synthetic oligonucleotide
  Target: ATXN1; (-) strand; PAM type: NNNNGHTT; PAM sequence: ATAAGTTT
ggtaacgtggaaatcctcag

SEQ ID NO: 25552 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
caattatagtacctgttata

SEQ ID NO: 25553 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
tttgagatgcggaaataatg

SEQ ID NO: 25554 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
gattacaagagtggtgtctt

SEQ ID NO: 25555 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tacctcagcctcccaaagtg

SEQ ID NO: 25556 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
agtttctaaaagtacatgat

SEQ ID NO: 25557 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
cagagttagtttctaaaagt

SEQ ID NO: 25558 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
acttcccctttaatcccaga

SEQ ID NO: 25559 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
gtctttaacaatatatagtt

SEQ ID NO: 25560 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgcctcggcctcccaaagtg

SEQ ID NO: 25561 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
agtctttagtatttttaata

SEQ ID NO: 25562 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
ccaattttttaggctggttg

SEQ ID NO: 25563 - DNA, 20 bp, Artificial Sequence
  Description of Artificial Sequence: Synthetic oligonucleotide
  Target: ATXN1; (-) strand; PAM type: NNNNGHTT; PAM sequence: CCGAGATT
gaagcagaggttgcagtgag

SEQ ID NO: 25564 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
tcaggaggctgagacaggag

SEQ ID NO: 25565 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
caggcggatcacctaaggtc

SEQ ID NO: 25566 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
tgaggttggtgagaggaaaa

SEQ ID NO: 25567 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
tcgcacctctgtaactgaac

SEQ ID NO: 25568 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
tggagtttggtttggtttgg

SEQ ID NO: 25569 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
agatttggagtttggtttgg

SEQ ID NO: 25570 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
tttggagatttggagtttgg

SEQ ID NO: 25571 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
ctgtctttggagatttggag

SEQ ID NO: 25572 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
aaggcctgtctttggagatt

SEQ ID NO: 25573 - DNA, 20 bp, Artificial Sequence
  Description of Artificial Sequence: Synthetic oligonucleotide
  Target: ATXN1; (-) strand; PAM type: NNNNGHTT; PAM sequence: TGGAGATT
ttaattctaaggcctgtctt

SEQ ID NO: 25574 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
aaaaaattccattaacgtca

SEQ ID NO: 25575 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
aatcgctcgaatccaggagg

SEQ ID NO: 25576 - DNA, 20 bp, Artificial Sequence
  Description of Artificial Sequence: Synthetic oligonucleotide
  Target: ATXN1; (-) strand; PAM type: NNNNGHTT; PAM sequence: ACTAGCTT
cctgagatcaggagttcaag

SEQ ID NO: 25577 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
gaaacaaagagaagcctttg

SEQ ID NO: 25578 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
gaataatcttccgctcccac

SEQ ID NO: 25579 - DNA, 20 bp, Artificial Sequence
  Description of Artificial Sequence: Synthetic oligonucleotide
  Target: ATXN1; (-) strand; PAM type: NNNNGHTT; PAM sequence: ATCAGATT
tccgatctgtgcctacaatg

SEQ ID NO: 25580 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
acctatttgagatgtgtgca

SEQ ID NO: 25581 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
aataaagatagatttgctat

SEQ ID NO: 25582 - DNA, 20 bp, Artificial Sequence
  Description of Artificial Sequence: Synthetic oligonucleotide
  Target: ATXN1; (-) strand; PAM type: NNNNGHTT; PAM sequence: GATAGATT
aaacctaattataaaataaa

SEQ ID NO: 25583 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
aatgatcagttaacctttaa

SEQ ID NO: 25584 - DNA, 20 bp, Artificial Sequence
  Description of Artificial Sequence: Synthetic oligonucleotide
  Target: ATXN1; (-) strand; PAM type: NNNNGHTT; PAM sequence: GTGAGATT
tctcactgagaaacccctca

SEQ ID NO: 25585 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
tctccaagggaatttcaagc

SEQ ID NO: 25586 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
agtccccgctggcattgaca

SEQ ID NO: 25587 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
atcctacaaaatcacaccgt

SEQ ID NO: 25588 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
gcatcatagagaatacccat

SEQ ID NO: 25589 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
aatcgcttgaacccaggagg

SEQ ID NO: 25590 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
tcgggaggctgaggcaggag

SEQ ID NO: 25591 - DNA, 20 bp, Artificial Sequence
  Description of Artificial Sequence: Synthetic oligonucleotide
  Target: ATXN1; (-) strand; PAM type: NNNNGHTT; PAM sequence: GGTGGCTT
tacaaaaattagccaggtgt

SEQ ID NO: 25592 - DNA, 20 bp, Artificial Sequence
  Description of Artificial Sequence: Synthetic oligonucleotide
  Target: ATXN1; (-) strand; PAM type: NNNNGHTT; PAM sequence: ACCCGTTT
ggtcactggtgtccaaatgt

SEQ ID NO: 25593 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
ctggtgtgttttaggtcact

SEQ ID NO: 25594 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
ggggcacatcgggaggtctg

SEQ ID NO: 25595 - DNA, 20 bp, Artificial Sequence
  Description of Artificial Sequence: Synthetic oligonucleotide
  Target: ATXN1; (-) strand; PAM type: NNNNGHTT; PAM sequence: GCTTGATT
agaaagtatgattccaaggt

SEQ ID NO: 25596 - DNA, 20 bp, Artificial Sequence
  Description of Artificial Sequence: Synthetic oligonucleotide
  Target: ATXN1; (-) strand; PAM type: NNNNGHTT; PAM sequence: AGGTGCTT
cggaagaaagtatgattcca

SEQ ID NO: 25597 - DNA, 20 bp, Artificial Sequence
  Description of Artificial Sequence: Synthetic oligonucleotide
  Target: ATXN1; (-) strand; PAM type: NNNNGHTT; PAM sequence: GTATGATT
aagagaaagagcggaagaaa

SEQ ID NO: 25598 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
atacagtttgcttataattg

SEQ ID NO: 25599 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
ttggaaaaggaacccataca

SEQ ID NO: 25600 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
gtatttggaaaaggaaccca

SEQ ID NO: 25601 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
tggtgaccgagcgagtgaga

SEQ ID NO: 25602 - DNA, 20 bp, Artificial Sequence
  Description of Artificial Sequence: Synthetic oligonucleotide
  Target: ATXN1; (-) strand; PAM type: NNNNGHTT; PAM sequence: TCAGGCTT
aggggcacatgcagaccaca

SEQ ID NO: 25603 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
ggcaacagtacgtgaggcaa

SEQ ID NO: 25604 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
gcaagagggcacttgaggcc

SEQ ID NO: 25605 - DNA, 20 bp, Artificial Sequence
  Description of Artificial Sequence: Synthetic oligonucleotide
  Target: ATXN1; (-) strand; PAM type: NNNNGHTT; PAM sequence: TCATGCTT
aaggggccaggctaggtggc

SEQ ID NO: 25606 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
ttcacgctcctatgagaatc

SEQ ID NO: 25607 - DNA, 20 bp, Artificial Sequence
  Description of Artificial Sequence: Synthetic oligonucleotide
  Target: ATXN1; (-) strand; PAM type: NNNNGHTT; PAM sequence: CGCAGTTT
caacctggattccttgcatg

SEQ ID NO: 25608 - DNA, 20 bp, Artificial Sequence
  Description of Artificial Sequence: Synthetic oligonucleotide
  Target: ATXN1; (-) strand; PAM type: NNNNGHTT; PAM sequence: CCTGGATT
ttctcataaggagtgcacaa

SEQ ID NO: 25609 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
cctcagatcatcaggcatta

SEQ ID NO: 25610 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
aggatgggaagagggagggg

SEQ ID NO: 25611 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
ccagggactggtttcatgga

SEQ ID NO: 25612 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
agtcccttttggcaccaggg

SEQ ID NO: 25613 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
tagactctggagatagaaca

SEQ ID NO: 25614 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
caccatgcccggcctcttct

SEQ ID NO: 25615 - DNA, 20 bp, Artificial Sequence
  Description of Artificial Sequence: Synthetic oligonucleotide
  Target: ATXN1; (-) strand; PAM type: NNNNGHTT; PAM sequence: GTGGGATT
cgcctctgcctcccaaagtg

SEQ ID NO: 25616 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtatttttagtagaga

SEQ ID NO: 25617 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tgcttcagccttcagagtag

SEQ ID NO: 25618 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
ctcccaggttcaagcaattc

SEQ ID NO: 25619 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cagttttttttttgttttgt

SEQ ID NO: 25620 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ttctttcagttttttttttg

SEQ ID NO: 25621 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
aactattctttcagtttttt

SEQ ID NO: 25622 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
aaggcaaacagaactattct

SEQ ID NO: 25623 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
gttgtccacttgtaccattg

SEQ ID NO: 25624 - DNA, 20 bp, Artificial Sequence
  Description of Artificial Sequence: Synthetic oligonucleotide
  Target: ATXN1; (-) strand; PAM type: NNNNGHTT; PAM sequence: GTGTGATT
gtggagagaaaataactgaa

SEQ ID NO: 25625 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
agcaagatcataaaatgact

SEQ ID NO: 25626 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
ctcccatgagtttattttca

SEQ ID NO: 25627 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
ttatctgtggtactgctccc

SEQ ID NO: 25628 - DNA, 20 bp, Artificial Sequence
  Description of Artificial Sequence: Synthetic oligonucleotide
  Target: ATXN1; (-) strand; PAM type: NNNNGHTT; PAM sequence: ACGTGCTT
gagctgtctggcgttatgta

SEQ ID NO: 25629 - DNA, 20 bp, Artificial Sequence
  Description of Artificial Sequence: Synthetic oligonucleotide
  Target: ATXN1; (-) strand; PAM type: NNNNGHTT; PAM sequence: GGGTGTTT
gctattctacttactgctta

SEQ ID NO: 25630 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
gttataaaggctattctact

SEQ ID NO: 25631 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
ttgggaggctgaggcaggag

SEQ ID NO: 25632 - DNA, 20 bp, Artificial Sequence
  Description of Artificial Sequence: Synthetic oligonucleotide
  Target: ATXN1; (-) strand; PAM type: NNNNGHTT; PAM sequence: TCAAGCTT
agatgaaagacagagggccc

SEQ ID NO: 25633 - DNA, 20 bp, Artificial Sequence
  Description of Artificial Sequence: Synthetic oligonucleotide
  Target: ATXN1; (-) strand; PAM type: NNNNGHTT; PAM sequence: ATGGGCTT
ataaccacactgatgagcac

SEQ ID NO: 25634 - DNA, 20 bp, Artificial Sequence
  Description of Artificial Sequence: Synthetic oligonucleotide
  Target: ATXN1; (-) strand; PAM type: NNNNGHTT; PAM sequence: AGTCGATT
ggaggtgacagttctagagg

SEQ ID NO: 25635 - DNA, 20 bp, Artificial Sequence
  Description of Artificial Sequence: Synthetic oligonucleotide
  Target: ATXN1; (-) strand; PAM type: NNNNGHTT; PAM sequence: GTCAGATT
ttcttaaaagccagtcatta

SEQ ID NO: 25636 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
taaatatgcgtgtatgtgca

SEQ ID NO: 25637 - DNA, 20 bp, Artificial Sequence
  Description of Artificial Sequence: Synthetic oligonucleotide
  Target: ATXN1; (-) strand; PAM type: NNNNGHTT; PAM sequence: CTAAGATT
tatatagacatagcaccaat

SEQ ID NO: 25638 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
gacgttttgttttctttcta

SEQ ID NO: 25639 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
acatatttaaacaacagacg

SEQ ID NO: 25640 - DNA, 20 bp, Artificial Sequence
  Description of Artificial Sequence: Synthetic oligonucleotide
  Target: ATXN1; (-) strand; PAM type: NNNNGHTT; PAM sequence: AGACGTTT
gggagacatatttaaacaac

SEQ ID NO: 25641 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
tctgggatagtgtcatgaaa

SEQ ID NO: 25642 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
acaagacatacttactgaaa

SEQ ID NO: 25643 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
ttcatctttgagacggggtt

SEQ ID NO: 25644 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
tacccccttcatctttgaga

SEQ ID NO: 25645 - DNA, 20 bp, Artificial Sequence
  Description of Artificial Sequence: Synthetic oligonucleotide
  Target: ATXN1; (-) strand; PAM type: NNNNGHTT; PAM sequence: TCTCGCTT
aacattgcagtaaatgggtc

SEQ ID NO: 25646 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
agcgttttgactgtttttat

SEQ ID NO: 25647 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
acactcagccaaagcgtttt

SEQ ID NO: 25648 - DNA, 20 bp, Artificial Sequence
  Description of Artificial Sequence: Synthetic oligonucleotide
  Target: ATXN1; (-) strand; PAM type: NNNNGHTT; PAM sequence: AAGCGTTT
gagattcttacactcagcca

SEQ ID NO: 25649 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
tgttttaaatagaacactca

SEQ ID NO: 25650 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
ggctttgcgtgaacatgatt

SEQ ID NO: 25651 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
ctgagtcaggctttgcgtga

SEQ ID NO: 25652 - DNA, 20 bp, Artificial Sequence
  Description of Artificial Sequence: Synthetic oligonucleotide
  Target: ATXN1; (-) strand; PAM type: NNNNGHTT; PAM sequence: TCAGGCTT
cacttccaccaaggactgag

SEQ ID NO: 25653 - DNA, 20 bp, Artificial Sequence
  Description of Artificial Sequence: Synthetic oligonucleotide
  Target: ATXN1; (-) strand; PAM type: NNNNGHTT; PAM sequence: GTGGGTTT
aggcgtcccggtgctagggt

SEQ ID NO: 25654 - DNA, 20 bp, Artificial Sequence
  Description of Artificial Sequence: Synthetic oligonucleotide
  Target: ATXN1; (-) strand; PAM type: NNNNGHTT; PAM sequence: GTGGGATT
agaaaaacccagcttttaat

SEQ ID NO: 25655 - DNA, 20 bp, Artificial Sequence
  Description of Artificial Sequence: Synthetic oligonucleotide
  Target: ATXN1; (-) strand; PAM type: NNNNGHTT; PAM sequence: CCCAGCTT
gctaccatgtgtaagaaaaa

SEQ ID NO: 25656 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
gagctagaacctgtgtgcct

SEQ ID NO: 25657 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgcctcaggcccccaaagtg

SEQ ID NO: 25658 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
gtgacaccataatagctcac

SEQ ID NO: 25659 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
actgatcattttactctctc

SEQ ID NO: 25660 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
agttcactctgtgttgtaca

SEQ ID NO: 25661 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
ccttatttttaactaaagtc

SEQ ID NO: 25662 - DNA, 20 bp, Artificial Sequence
  Description of Artificial Sequence: Synthetic oligonucleotide
  Target: ATXN1; (-) strand; PAM type: NNNNGHTT; PAM sequence: GATAGATT
ttaaaatcttgcattggtgt

SEQ ID NO: 25663 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
gagagaggtctcacacacct

SEQ ID NO: 25664 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
aattaaagactattgtttaa

SEQ ID NO: 25665 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
tttagaaaaaaattaaagac

SEQ ID NO: 25666 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
ttttgattctctcagactgt

SEQ ID NO: 25667 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
caactgggtcatcttatatg

SEQ ID NO: 25668 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
gcccccaactgggtcatctt

SEQ ID NO: 25669 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gaaactatgtcaaaccacat

SEQ ID NO: 25670 - DNA, 20 bp, Artificial Sequence
  Description of Artificial Sequence: Synthetic oligonucleotide
  Target: ATXN1; (-) strand; PAM type: NNNNGHTT; PAM sequence: CCTGGATT
ccctgtgtgcagagcccagc

SEQ ID NO: 25671 - DNA, 20 bp, Artificial Sequence
  Description of Artificial Sequence: Synthetic oligonucleotide
  Target: ATXN1; (-) strand; PAM type: NNNNGHTT; PAM sequence: CCGAGCTT
acttgccaacattgaacatg

SEQ ID NO: 25672 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
ggtggtaacattatgcattg

SEQ ID NO: 25673 - DNA, 20 bp, Artificial Sequence
  Description of Artificial Sequence: Synthetic oligonucleotide
  Target: ATXN1; (-) strand; PAM type: NNNNGHTT; PAM sequence: GATGGCTT
gtacttactggctgtctacc

SEQ ID NO: 25674 - DNA, 20 bp, Artificial Sequence
  Description of Artificial Sequence: Synthetic oligonucleotide
  Target: ATXN1; (-) strand; PAM type: NNNNGHTT; PAM sequence: GGCTGCTT
gactgcttccctgactcggt

SEQ ID NO: 25675 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
ttcccagcgcctcccgaggt

SEQ ID NO: 25676 - DNA, 20 bp, Artificial Sequence
  Description of Artificial Sequence: Synthetic oligonucleotide
  Target: ATXN1; (-) strand; PAM type: NNNNGHTT; PAM sequence: TGTCGCTT
tctgtgttattagggccgtc

SEQ ID NO: 25677 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
tgctctgggttgacacgttc

SEQ ID NO: 25678 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
tctgtctcacccttcctagg

SEQ ID NO: 25679 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
atggccccagctggggagcc

SEQ ID NO: 25680 - DNA, 20 bp, Artificial Sequence
  Description of Artificial Sequence: Synthetic oligonucleotide
  Target: ATXN1; (-) strand; PAM type: NNNNGHTT; PAM sequence: ACTGGATT
atctgtatttctgagtatga

SEQ ID NO: 25681 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
gcgagcacccttcccgccgt

SEQ ID NO: 25682 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
caaaggcctcgtgttctaaa

SEQ ID NO: 25683 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
agatggctcgggccctgaga

SEQ ID NO: 25684 - DNA, 20 bp, Artificial Sequence
  Description of Artificial Sequence: Synthetic oligonucleotide
  Target: ATXN1; (-) strand; PAM type: NNNNGHTT; PAM sequence: CCCTGCTT
tgcaatgttagttttccctt

SEQ ID NO: 25685 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
gcactgggaccttgtgcaat

SEQ ID NO: 25686 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
ccttgggtaggaagtaggtt

SEQ ID NO: 25687 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
aatgcaactcaaaagaagga

SEQ ID NO: 25688 - DNA, 20 bp, Artificial Sequence
  Description of Artificial Sequence: Synthetic oligonucleotide
  Target: ATXN1; (-) strand; PAM type: NNNNGHTT; PAM sequence: CCAAGTTT
tataatccacttaatatcct

SEQ ID NO: 25689 - DNA, 20 bp, Artificial Sequence
  Description of Artificial Sequence: Synthetic oligonucleotide
  Target: ATXN1; (-) strand; PAM type: NNNNGHTT; PAM sequence: CCTTGATT
agagttgctgctttgccatg

SEQ ID NO: 25690 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
tccccaccctggaagagagt

SEQ ID NO: 25691 - DNA, 20 bp, Artificial Sequence
  Description of Artificial Sequence: Synthetic oligonucleotide
  Target: ATXN1; (-) strand; PAM type: NNNNGHTT; PAM sequence: TACAGCTT
tgtggcattgccctgcccag

SEQ ID NO: 25692 - DNA, 20 bp, Artificial Sequence
  Description of Artificial Sequence: Synthetic oligonucleotide
  Target: ATXN1; (-) strand; PAM type: NNNNGHTT; PAM sequence: CCGTGTTT
tgtaggagaaaaatgctttt

SEQ ID NO: 25693 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
gacgaggcaatgtaggagaa

SEQ ID NO: 25694 - DNA, 20 bp, Artificial Sequence
  Description of Artificial Sequence: Synthetic oligonucleotide
  Target: ATXN1; (-) strand; PAM type: NNNNGHTT; PAM sequence: GGATGATT
ctgaggggtgtttagtttgg

SEQ ID NO: 25695 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
gcatataaaactgaggggtg

SEQ ID NO: 25696 - DNA, 20 bp, Artificial Sequence
  Description of Artificial Sequence: Synthetic oligonucleotide
  Target: ATXN1; (-) strand; PAM type: NNNNGHTT; PAM sequence: GGGTGTTT
ccatggcatataaaactgag

SEQ ID NO: 25697 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
cttgagagggttccgttttt

SEQ ID NO: 25698 - DNA, 20 bp, Artificial Sequence
  Description of Artificial Sequence: Synthetic oligonucleotide
  Target: ATXN1; (-) strand; PAM type: NNNNGHTT; PAM sequence: TTCCGTTT
gagataatctcttgagaggg

SEQ ID NO: 25699 - DNA, 20 bp, Artificial Sequence
  Description of Artificial Sequence: Synthetic oligonucleotide
  Target: ATXN1; (-) strand; PAM type: NNNNGHTT; PAM sequence: GTATGATT
gagccacggcgcccggccac

SEQ ID NO: 25700 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cacctcggtctcccaaaatg

SEQ ID NO: 25701 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
tctgtgtttttttgtagaga

SEQ ID NO: 25702 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
cactacacccagctaatttt

SEQ ID NO: 25703 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
gtttttgtgttcgtttgttt

SEQ ID NO: 25704 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
gtgggtttttgtgttcgttt

SEQ ID NO: 25705 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
ttctgtgggtttttgtgttc

SEQ ID NO: 25706 - DNA, 20 bp, Artificial Sequence
  Description of Artificial Sequence: Synthetic oligonucleotide
  Target: ATXN1; (-) strand; PAM type: NNNNGHTT; PAM sequence: GTTCGTTT
gtttttctgtgggtttttgt

SEQ ID NO: 25707 - DNA, 20 bp, Artificial Sequence
  Description of Artificial Sequence: Synthetic oligonucleotide
  Target: ATXN1; (-) strand; PAM type: NNNNGHTT; PAM sequence: GTGGGTTT
caaatgagttttgtttttct

SEQ ID NO: 25708 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ctctaaaccaggcaaatgag

SEQ ID NO: 25709 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
ctcctctctaaaccaggcaa

SEQ ID NO: 25710 - DNA, 20 bp, Artificial Sequence
  Description of Artificial Sequence: Synthetic oligonucleotide
  Target: ATXN1; (-) strand; PAM type: NNNNGHTT; PAM sequence: TGCGGATT
ggtggtgacagacccagggg

SEQ ID NO: 25711 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
ggggaagttgtggaagaaga

SEQ ID NO: 25712 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
cttaataagcaaaatcacaa

SEQ ID NO: 25713 - DNA, 20 bp, Artificial Sequence
  Description of Artificial Sequence: Synthetic oligonucleotide
  Target: ATXN1; (-) strand; PAM type: NNNNGHTT; PAM sequence: TTGAGCTT
attcagaaatgtgcaaattg

SEQ ID NO: 25714 - DNA, 20 bp, Artificial Sequence
  Description of Artificial Sequence: Synthetic oligonucleotide
  Target: ATXN1; (-) strand; PAM type: NNNNGHTT; PAM sequence: AGGGGTTT
ccctctgcagtgccttcctg

SEQ ID NO: 25715 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
cagctaaaatactccaccag

SEQ ID NO: 25716 - DNA, 20 bp, Artificial Sequence
  Description of Artificial Sequence: Synthetic oligonucleotide
  Target: ATXN1; (-) strand; PAM type: NNNNGHTT; PAM sequence: CAATGATT
agtgcaaggcctgacgcaac

SEQ ID NO: 25717 - DNA, 20 bp, Artificial Sequence
  Description of Artificial Sequence: Synthetic oligonucleotide
  Target: ATXN1; (-) strand; PAM type: NNNNGHTT; PAM sequence: TAGGGCTT
agacctgctgaaaaggcagc

SEQ ID NO: 25718 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
tggctatgctgcatgccggg

SEQ ID NO: 25719 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
gtgaagtcagagccctgttc

SEQ ID NO: 25720 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
aatgattaaatgaaagagaa

SEQ ID NO: 25721 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
tactccaaactttgcaaaat

SEQ ID NO: 25722 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
tcttggggaggaagatctag

SEQ ID NO: 25723 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cccgcctcagcctcctaaag

SEQ ID NO: 25724 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
ggtctcgaactcctgacctc

SEQ ID NO: 25725 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtatttttagtagaga

SEQ ID NO: 25726 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
caacatctgcctcttggttc

SEQ ID NO: 25727 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
ccttgccggccagcatcaac

SEQ ID NO: 25728 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gaggcaggtgtgaaaagagg

SEQ ID NO: 25729 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
gaacagaggcaggtgtgaaa

SEQ ID NO: 25730 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
aataaacatgagtgaagagt

SEQ ID NO: 25731 - DNA, 20 bp, Artificial Sequence
  Description of Artificial Sequence: Synthetic oligonucleotide
  Target: ATXN1; (-) strand; PAM type: NNNNGHTT; PAM sequence: TCAGGATT
tatttaaaaaaaaaagaaaa

SEQ ID NO: 25732 - DNA, 20 bp, Artificial Sequence
  Description of Artificial Sequence: Synthetic oligonucleotide
  Target: ATXN1; (-) strand; PAM type: NNNNGHTT; PAM sequence: GAAAGATT
cagtctttggaagggcccaa

SEQ ID NO: 25733 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
ttgtattatgagatgtcact

SEQ ID NO: 25734 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
agccggggccctgcattgcc

SEQ ID NO: 25735 - DNA, 20 bp, Artificial Sequence
  Description of Artificial Sequence: Synthetic oligonucleotide
  Target: ATXN1; (-) strand; PAM type: NNNNGHTT; PAM sequence: GGGGGCTT
actcgtgaatgactggatat

SEQ ID NO: 25736 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
ccaagtgaggaaaggaccaa

SEQ ID NO: 25737 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
tacagacacgagtccctatg

SEQ ID NO: 25738 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
cacctcggcctcccaaagcc

SEQ ID NO: 25739 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
tttttttttcatttttgaga

SEQ ID NO: 25740 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
ataaactaattaatggtttg

SEQ ID NO: 25741 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
aaaaaaaagataaactaatt

SEQ ID NO: 25742 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
caaatgggacagagcctcct

SEQ ID NO: 25743 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
ctttctacaagtgtttccat

SEQ ID NO: 25744 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
ctatcgagcgtactttctac

SEQ ID NO: 25745 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
agcaggttcagcctgcagct

SEQ ID NO: 25746 - DNA, 20 bp, Artificial Sequence
  Description of Artificial Sequence: Synthetic oligonucleotide
  Target: ATXN1; (-) strand; PAM type: NNNNGHTT; PAM sequence: GATCGATT
tacccttttccaggttctta

SEQ ID NO: 25747 - DNA, 20 bp, Artificial Sequence
  Description of Artificial Sequence: Synthetic oligonucleotide
  Target: ATXN1; (-) strand; PAM type: NNNNGHTT; PAM sequence: CTGGGCTT
gggctgtcccaggtgacctg

SEQ ID NO: 25748 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
taggaattagctctggactg

SEQ ID NO: 25749 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
ggggagtgggctctggactg

SEQ ID NO: 25750 - DNA, 20 bp, Artificial Sequence
  Description of Artificial Sequence: Synthetic oligonucleotide
  Target: ATXN1; (-) strand; PAM type: NNNNGHTT; PAM sequence: TGGGGATT
aattgcatgaacccgggagg

SEQ ID NO: 25751 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
gggaggcagggtaaacgggt

SEQ ID NO: 25752 - DNA, 20 bp, Artificial Sequence
  Description of Artificial Sequence: Synthetic oligonucleotide
  Target: ATXN1; (-) strand; PAM type: NNNNGHTT; PAM sequence: ACGGGTTT
tttcatgggaggcagggtaa

SEQ ID NO: 25753 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
tggcaaacaacagcctttat

SEQ ID NO: 25754 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
atcatatcccattgcaacat

SEQ ID NO: 25755 - DNA, 20 bp, Artificial Sequence
  Description of Artificial Sequence: Synthetic oligonucleotide
  Target: ATXN1; (-) strand; PAM type: NNNNGHTT; PAM sequence: AGGGGATT
cagaggatgccgttggagtg

SEQ ID NO: 25756 - DNA, 20 bp, Artificial Sequence
  Description of Artificial Sequence: Synthetic oligonucleotide
  Target: ATXN1; (-) strand; PAM type: NNNNGHTT; PAM sequence: CCCTGATT
tctgtgattaagatgaggaa

SEQ ID NO: 25757 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
ctctagttattttttgaatt

SEQ ID NO: 25758 - DNA, 20 bp, Artificial Sequence
  Description of Artificial Sequence: Synthetic oligonucleotide
  Target: ATXN1; (-) strand; PAM type: NNNNGHTT; PAM sequence: GCAGGATT
agacgaattgcttctatgag

SEQ ID NO: 25759 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
catcatctcctggcaagacg

SEQ ID NO: 25760 - DNA, 20 bp, Artificial Sequence
  Description of Artificial Sequence: Synthetic oligonucleotide
  Target: ATXN1; (-) strand; PAM type: NNNNGHTT; PAM sequence: AGAGGATT
gatcgactccagcaccgtag

SEQ ID NO: 25761 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
aaggtggaagacttaaaaac

SEQ ID NO: 25762 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
ggccatagtcacgtcatccc

SEQ ID NO: 25763 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
acggtcattcagaccacaca

SEQ ID NO: 25764 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
cccaatacagtggaacctat

SEQ ID NO: 25765 - DNA, 20 bp, Artificial Sequence
  Description of Artificial Sequence: Synthetic oligonucleotide
  Target: ATXN1; (-) strand; PAM type: NNNNGHTT; PAM sequence: ATAGGTTT
agcttggtttacaacaggga

SEQ ID NO: 25766 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
cggcagggacctcggtggag

SEQ ID NO: 25767 - DNA, 20 bp, Artificial Sequence
  Description of Artificial Sequence: Synthetic oligonucleotide
  Target: ATXN1; (-) strand; PAM type: NNNNGHTT; PAM sequence: TGGAGCTT
tgggccggcagggacctcgg

SEQ ID NO: 25768 - DNA, 20 bp, Artificial Sequence
  Description of Artificial Sequence: Synthetic oligonucleotide
  Target: ATXN1; (-) strand; PAM type: NNNNGHTT; PAM sequence: TTCCGTTT
tacagaaatcaaatgtgact

SEQ ID NO: 25769 - DNA, 20 bp, Artificial Sequence
  Description of Artificial Sequence: Synthetic oligonucleotide
  Target: ATXN1; (-) strand; PAM type: NNNNGHTT; PAM sequence: AGATGATT
ggcggattgtacccacgggg

SEQ ID NO: 25770 - DNA, 20 bp, Artificial Sequence
  Description of Artificial Sequence: Synthetic oligonucleotide
  Target: ATXN1; (-) strand; PAM type: NNNNGHTT; PAM sequence: GGCGGATT
cagcatccagagctgctgtt

SEQ ID NO: 25771 - DNA, 20 bp, Artificial Sequence
  Description of Artificial Sequence: Synthetic oligonucleotide
  Target: ATXN1; (-) strand; PAM type: NNNNGHTT; PAM sequence: GTATGATT
tctctgcttcagtgcttggg

SEQ ID NO: 25772 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
ggctagtgttttctctgctt

SEQ ID NO: 25773 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
aaagtgttggctagtgtttt

SEQ ID NO: 25774 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
cggcctcccaaagtgttggc

SEQ ID NO: 25775 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttttatttttggtagaga

SEQ ID NO: 25776 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
ctaatgttacaccaggctaa

SEQ ID NO: 25777 - DNA, 20 bp, Artificial Sequence
  Description of Artificial Sequence: Synthetic oligonucleotide
  Target: ATXN1; (-) strand; PAM type: NNNNGHTT; PAM sequence: TTTCGTTT
tttttgttgttgttgttttg

SEQ ID NO: 25778 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ttttgtttttgttgttgttg

SEQ ID NO: 25779 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
agtgtttttgtttttgttgt

SEQ ID NO: 25780 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gcagctgccacggctagtgt

SEQ ID NO: 25781 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
taatgtgcagctgccacggc

SEQ ID NO: 25782 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
cagctggtgtcatgctctcc

SEQ ID NO: 25783 - DNA, 20 bp, Artificial Sequence
  Description of Artificial Sequence: Synthetic oligonucleotide
  Target: ATXN1; (-) strand; PAM type: NNNNGHTT; PAM sequence: ACCTGCTT
gttctggactttcactgcta

SEQ ID NO: 25784 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
agagtagtggctctggcaga

SEQ ID NO: 25785 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
tgctgagttggcgtgtgtgt

SEQ ID NO: 25786 - DNA, 20 bp, Artificial Sequence
  Description of Artificial Sequence: Synthetic oligonucleotide
  Target: ATXN1; (-) strand; PAM type: NNNNGHTT; PAM sequence: ACAGGATT
tcttttgaaacttgcagaga

SEQ ID NO: 25787 - DNA, 20 bp, Artificial Sequence
  Description of Artificial Sequence: Synthetic oligonucleotide
  Target: ATXN1; (-) strand; PAM type: NNNNGHTT; PAM sequence: TTCGGTTT
gttttttaaccataatcaaa

SEQ ID NO: 25788 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
gccctatttttgtatggtat

SEQ ID NO: 25789 - DNA, 20 bp, Artificial Sequence
  Description of Artificial Sequence: Synthetic oligonucleotide
  Target: ATXN1; (-) strand; PAM type: NNNNGHTT; PAM sequence: ATCTGATT
gtccaggtttgaacacactg

SEQ ID NO: 25790 - DNA, 20 bp, Artificial Sequence
  Description of Artificial Sequence: Synthetic oligonucleotide
  Target: ATXN1; (-) strand; PAM type: NNNNGHTT; PAM sequence: CCAGGTTT
cagggtcaccatttgtatgt

SEQ ID NO: 25791 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
tggcctcttgtctgttgggc

SEQ ID NO: 25792 - DNA, 20 bp, Artificial Sequence
  Description of Artificial Sequence: Synthetic oligonucleotide
  Target: ATXN1; (-) strand; PAM type: NNNNGHTT; PAM sequence: CGCTGCTT
cctgtggaagcaatcacatc

SEQ ID NO: 25793 - DNA, 20 bp, Artificial Sequence
  Description of Artificial Sequence: Synthetic oligonucleotide
  Target: ATXN1; (-) strand; PAM type: NNNNGHTT; PAM sequence: CCAGGATT
ggaaggaggatttcttgagg

SEQ ID NO: 25794 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
cactttgggaggccaaggaa

SEQ ID NO: 25795 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gaaggccgctactttattgt

SEQ ID NO: 25796 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
tgctgaaggccgctacttta

SEQ ID NO: 25797 - DNA, 20 bp, Artificial Sequence
  Description of Artificial Sequence: Synthetic oligonucleotide
  Target: ATXN1; (-) strand; PAM type: NNNNGHTT; PAM sequence: CAAGGATT
cagtgttgctccaacatgga

SEQ ID NO: 25798 - DNA, 20 bp, Artificial Sequence
  Description of Artificial Sequence: Synthetic oligonucleotide
  Target: ATXN1; (-) strand; PAM type: NNNNGHTT; PAM sequence: TAGGGATT
gaaagggggttatgtttcag

SEQ ID NO: 25799 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
ggcagagtagagaaaggggg

SEQ ID NO: 25800 - DNA, 20 bp, Artificial Sequence
  Description of Artificial Sequence: Synthetic oligonucleotide
  Target: ATXN1; (-) strand; PAM type: NNNNGHTT; PAM sequence: TAAGGATT
agatatctgatcaaaatcat

SEQ ID NO: 25801 - DNA, 20 bp, Artificial Sequence
  Description of Artificial Sequence: Synthetic oligonucleotide
  Target: ATXN1; (-) strand; PAM type: NNNNGHTT; PAM sequence: TAGGGTTT
tttcttcagcataagtgttt

SEQ ID NO: 25802 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
acacttcatttcttcagcat

SEQ ID NO: 25803 - DNA, 20 bp, Artificial Sequence
  Description of Artificial Sequence: Synthetic oligonucleotide
  Target: ATXN1; (-) strand; PAM type: NNNNGHTT; PAM sequence: CCGAGATT
gaggcggaggttgcagtgag

SEQ ID NO: 25804 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
tcaggaggctgaggcaggag

SEQ ID NO: 25805 - DNA, 20 bp, Artificial Sequence
  Description of Artificial Sequence: Synthetic oligonucleotide
  Target: ATXN1; (-) strand; PAM type: NNNNGHTT; PAM sequence: GAGCGTTT
tcgttggtatggaaatgtgg

SEQ ID NO: 25806 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
tctctgagtaggtctcacgc

SEQ ID NO: 25807 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
atatccctcatgaaaccctg

SEQ ID NO: 25808 - DNA, 20 bp, Artificial Sequence
  Description of Artificial Sequence: Synthetic oligonucleotide
  Target: ATXN1; (-) strand; PAM type: NNNNGHTT; PAM sequence: CGCTGCTT
ctttgaaaggacttttatgc

SEQ ID NO: 25809 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
tgaatgtgtttgacatttta

SEQ ID NO: 25810 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
tgctaatagacccttcctga

SEQ ID NO: 25811 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
aagtaccttcagaggagttt

SEQ ID NO: 25812 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tcctaaagaagtaccttcag

SEQ ID NO: 25813 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
tctttttcaaatttacgaaa

SEQ ID NO: 25814 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
taagttttcagaagaataaa

SEQ ID NO: 25815 - DNA, 20 bp, Artificial Sequence
  Description of Artificial Sequence: Synthetic oligonucleotide
  Target: ATXN1; (-) strand; PAM type: NNNNGHTT; PAM sequence: ATAAGTTT
aagatgctgtttatcaatgg

SEQ ID NO: 25816 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
ttggcaatctctggaaaaga

SEQ ID NO: 25817 - DNA, 20 bp, Artificial Sequence
  Description of Artificial Sequence: Synthetic oligonucleotide
  Target: ATXN1; (-) strand; PAM type: NNNNGHTT; PAM sequence: CCTTGATT
tgctgtcttaatcattgtgt

SEQ ID NO: 25818 - DNA, 20 bp, Artificial Sequence
  Description of Artificial Sequence: Synthetic oligonucleotide
  Target: ATXN1; (-) strand; PAM type: NNNNGHTT; PAM sequence: ATCGGTTT
gaggatgggtggaaactttt

SEQ ID NO: 25819 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
ggtttccccttatcagtact

SEQ ID NO: 25820 - DNA, 20 bp, Artificial Sequence
  Description of Artificial Sequence: Synthetic oligonucleotide
  Target: ATXN1; (-) strand; PAM type: NNNNGHTT; PAM sequence: GTGGGTTT
gcaagacccaatctctaccc

SEQ ID NO: 25821 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
accttcataagttacttctt

SEQ ID NO: 25822 - DNA, 20 bp, Artificial Sequence
  Description of Artificial Sequence: Synthetic oligonucleotide
  Target: ATXN1; (-) strand; PAM type: NNNNGHTT; PAM sequence: TTTCGTTT
tccttttttcttttttcttc

SEQ ID NO: 25823 - DNA, 20 bp, Artificial Sequence
  Description of Artificial Sequence: Synthetic oligonucleotide
  Target: ATXN1; (-) strand; PAM type: NNNNGHTT; PAM sequence: AGGTGCTT
agaaatctttttgttgtggc

SEQ ID NO: 25824 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
tgatataattgtgcatggcc

SEQ ID NO: 25825 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
caatttcccttttccaatag

SEQ ID NO: 25826 - DNA, 20 bp, Artificial Sequence
  Description of Artificial Sequence: Synthetic oligonucleotide
  Target: ATXN1; (-) strand; PAM type: NNNNGHTT; PAM sequence: TCTTGATT
gcaaactctaaatacatttg

SEQ ID NO: 25827 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
taagatgaatgtattcagaa

SEQ ID NO: 25828 - DNA, 20 bp, Artificial Sequence
  Description of Artificial Sequence: Synthetic oligonucleotide
  Target: ATXN1; (-) strand; PAM type: NNNNGHTT; PAM sequence: AGCGGCTT
gatagttaatgtagctctaa

SEQ ID NO: 25829 - DNA, 20 bp, Artificial Sequence
  Description of Artificial Sequence: Synthetic oligonucleotide
  Target: ATXN1; (-) strand; PAM type: NNNNGHTT; PAM sequence: TAGGGTTT
aaatttaatcggatagctgc

SEQ ID NO: 25830 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
tagagatgtttaatttgctt

SEQ ID NO: 25831 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
gaagaggctagagatgttta

SEQ ID NO: 25832 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
ctccattaggaagaggctag

SEQ ID NO: 25833 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
tgtttacgtacaacacctag

SEQ ID NO: 25834 - DNA, 20 bp, Artificial Sequence
  Description of Artificial Sequence: Synthetic oligonucleotide
  Target: ATXN1; (-) strand; PAM type: NNNNGHTT; PAM sequence: CCTAGTTT
ctctgtgtttacgtacaaca

SEQ ID NO: 25835 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
tctccgaggctccatcaact

SEQ ID NO: 25836 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
tggagcatcacctaaatatt

SEQ ID NO: 25837 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
atttgttatttgcagccgta

SEQ ID NO: 25838 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
aatttcatttttcttcctgg

SEQ ID NO: 25839 - DNA, 20 bp, Artificial Sequence
  Description of Artificial Sequence: Synthetic oligonucleotide
  Target: ATXN1; (-) strand; PAM type: NNNNGHTT; PAM sequence: TGGAGCTT
ttatagcaaagaaagaagtg

SEQ ID NO: 25840 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
taggtttaagatgtattttt

SEQ ID NO: 25841 - DNA, 20 bp, Artificial Sequence
  Description of Artificial Sequence: Synthetic oligonucleotide
  Target: ATXN1; (-) strand; PAM type: NNNNGHTT; PAM sequence: CTAGGTTT
aagcaacccattttcttgcc

SEQ ID NO: 25842 - DNA, 20 bp, Artificial Sequence
  Description of Artificial Sequence: Synthetic oligonucleotide
  Target: ATXN1; (-) strand; PAM type: NNNNGHTT; PAM sequence: ACAGGATT
gttcattcaaactgagaagc

SEQ ID NO: 25843 - DNA, 20 bp, Artificial Sequence
  Description of Artificial Sequence: Synthetic oligonucleotide
  Target: ATXN1; (-) strand; PAM type: NNNNGHTT; PAM sequence: CCCTGTTT
tctttaaagctgaaaccgtg

SEQ ID NO: 25844 - DNA, 20 bp, Artificial Sequence
  Description of Artificial Sequence: Synthetic oligonucleotide
  Target: ATXN1; (-) strand; PAM type: NNNNGHTT; PAM sequence: CGTAGTTT
ccctcttcagtgtttgcata

SEQ ID NO: 25845 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
cccaggtattctgccctctt

SEQ ID NO: 25846 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
agtgatgtaataaagctgga

SEQ ID NO: 25847 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
ccagtgcaccacacaggcct

SEQ ID NO: 25848 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
tttaatgcttggccaaaatg

SEQ ID NO: 25849 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
gtcgggtttggacctgtttt

SEQ ID NO: 25850 - DNA, 20 bp, Artificial Sequence
  Description of Artificial Sequence: Synthetic oligonucleotide
  Target: ATXN1; (-) strand; PAM type: NNNNGHTT; PAM sequence: ACCTGTTT
tccaagcatgtcgggtttgg

SEQ ID NO: 25851 - DNA, 20 bp, Artificial Sequence
  Description of Artificial Sequence: Synthetic oligonucleotide
  Target: ATXN1; (-) strand; PAM type: NNNNGHTT; PAM sequence: TCGGGTTT
ttctagatactccaagcatg

SEQ ID NO: 25852 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
atacatactagaaacggaat

SEQ ID NO: 25853 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
aaatagagttctggcatacc

SEQ ID NO: 25854 - DNA, 20 bp, Artificial Sequence
  Description of Artificial Sequence: Synthetic oligonucleotide
  Target: ATXN1; (-) strand; PAM type: NNNNGHTT; PAM sequence: TCCGGCTT
cctggtttggtaccatcact

SEQ ID NO: 25855 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
ttctcattgatcttaatttt

SEQ ID NO: 25856 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
gctcctgggctcccaaagtg

SEQ ID NO: 25857 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
tctcttttcttgagacaggg

SEQ ID NO: 25858 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
atttattcccttattctgaa

SEQ ID NO: 25859 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
ctttgcagcaggatttcaac

SEQ ID NO: 25860 - DNA, 20 bp, Artificial Sequence
  Description of Artificial Sequence: Synthetic oligonucleotide
  Target: ATXN1; (-) strand; PAM type: NNNNGHTT; PAM sequence: GCAGGATT
ccttcccacgtgcctttgca

SEQ ID NO: 25861 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
agttgtctcagctgttactc

SEQ ID NO: 25862 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
ttctcattgcttcctaatgc

SEQ ID NO: 25863 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
agtccatttttaaccattct

SEQ ID NO: 25864 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
gggacccctaccccatatcc

SEQ ID NO: 25865 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
catggaagagaaggtcaata

SEQ ID NO: 25866 - DNA, 20 bp, Artificial Sequence
  Description of Artificial Sequence: Synthetic oligonucleotide
  Target: ATXN1; (-) strand; PAM type: NNNNGHTT; PAM sequence: CCACGCTT
gaggcctgccccatgaagct

SEQ ID NO: 25867 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
aggtcccagctcgcctctct

SEQ ID NO: 25868 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
ttggattacgagctttcatt

SEQ ID NO: 25869 - DNA, 20 bp, Artificial Sequence
  Description of Artificial Sequence: Synthetic oligonucleotide
  Target: ATXN1; (-) strand; PAM type: NNNNGHTT; PAM sequence: ACGAGCTT
gactccttctagcttggatt

SEQ ID NO: 25870 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
ctcgtgtggactccttctag

SEQ ID NO: 25871 - DNA, 20 bp, Artificial Sequence
  Description of Artificial Sequence: Synthetic oligonucleotide
  Target: ATXN1; (-) strand; PAM type: NNNNGHTT; PAM sequence: TCTAGCTT
aggccctcgtgtggactcct

SEQ ID NO: 25872 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
tctagtagcttcgggtgatc

SEQ ID NO: 25873 - DNA, 20 bp, Artificial Sequence
  Description of Artificial Sequence: Synthetic oligonucleotide
  Target: ATXN1; (-) strand; PAM type: NNNNGHTT; PAM sequence: AGTAGCTT
ccttgcttcttgctgcttct

SEQ ID NO: 25874 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
gataatctttccttgcttct

SEQ ID NO: 25875 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
ggctctaggggataatcttt

SEQ ID NO: 25876 - DNA, 20 bp, Artificial Sequence
  Description of Artificial Sequence: Synthetic oligonucleotide
  Target: ATXN1; (-) strand; PAM type: NNNNGHTT; PAM sequence: GGAGGCTT
aagtattctctaacactcct

SEQ ID NO: 25877 - DNA, 20 bp, Artificial Sequence
  Description of Artificial Sequence: Synthetic oligonucleotide
  Target: ATXN1; (-) strand; PAM type: NNNNGHTT; PAM sequence: CGTGGCTT
aataaattaccaaaacatat

SEQ ID NO: 25878 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
aataaatggaagatatttgg

SEQ ID NO: 25879 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
taatcaataaatggaagata

SEQ ID NO: 25880 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
catggttgggtagactaaga

SEQ ID NO: 25881 - DNA, 20 bp, Artificial Sequence
  Description of Artificial Sequence: Synthetic oligonucleotide
  Target: ATXN1; (-) strand; PAM type: NNNNGHTT; PAM sequence: TCTTGATT
aacgtctcaccagctgcagt

SEQ ID NO: 25882 - DNA, 20 bp, Artificial Sequence
  Description of Artificial Sequence: Synthetic oligonucleotide
  Target: ATXN1; (-) strand; PAM type: NNNNGHTT; PAM sequence: GCTTGCTT
tgctgagcctgaggtcccct

SEQ ID NO: 25883 - DNA, 20 bp, Artificial Sequence
  Description of Artificial Sequence: Synthetic oligonucleotide
  Target: ATXN1; (-) strand; PAM type: NNNNGHTT; PAM sequence: CCCTGCTT
tggctgctgagcctgaggtc

SEQ ID NO: 25884 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
tgtgacactagagggagaga

SEQ ID NO: 25885 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
ttcttgtgacactagaggga

SEQ ID NO: 25886 - DNA, 20 bp, Artificial Sequence
  Description of Artificial Sequence: Synthetic oligonucleotide
  Target: ATXN1; (-) strand; PAM type: NNNNGHTT; PAM sequence: ACTTGCTT
gtgccaggttgcaggcttga

SEQ ID NO: 25887 - DNA, 20 bp, Artificial Sequence
  Description of Artificial Sequence: Synthetic oligonucleotide
  Target: ATXN1; (-) strand; PAM type: NNNNGHTT; PAM sequence: GCAGGCTT
aggggagcctgtgccaggtt

SEQ ID NO: 25888 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
tcccagctggcagtggtagt

SEQ ID NO: 25889 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
tggggctgcttttctcctgc

SEQ ID NO: 25890 - DNA, 20 bp, Artificial Sequence
  Description of Artificial Sequence: Synthetic oligonucleotide
  Target: ATXN1; (-) strand; PAM type: NNNNGHTT; PAM sequence: GGCTGCTT
gctgataatataagtagtgg

SEQ ID NO: 25891 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
gtggatttaaattttttaat

SEQ ID NO: 25892 - DNA, 20 bp, Artificial Sequence
  Description of Artificial Sequence: Synthetic oligonucleotide
  Target: ATXN1; (-) strand; PAM type: NNNNGHTT; PAM sequence: GGTGGATT
cgaatgagactattattttg

SEQ ID NO: 25893 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
cagccacatggccgatgtcc

SEQ ID NO: 25894 - DNA, 20 bp, Artificial Sequence
  Description of Artificial Sequence: Synthetic oligonucleotide
  Target: ATXN1; (-) strand; PAM type: NNNNGHTT; PAM sequence: GCCGGCTT
gcagcgcgttttccatgtga

SEQ ID NO: 25895 - DNA, 20 bp, Artificial Sequence
  Description of Artificial Sequence: Synthetic oligonucleotide
  Target: ATXN1; (-) strand; PAM type: NNNNGHTT; PAM sequence: GCGCGTTT
ctggctacacagccactgca

SEQ ID NO: 25896 - DNA, 20 bp, Artificial Sequence
  Description of Artificial Sequence: Synthetic oligonucleotide
  Target: ATXN1; (-) strand; PAM type: NNNNGHTT; PAM sequence: ACCAGCTT
tgtcagacaattcatttggg

SEQ ID NO: 25897 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
ggtcttgacagaaaggcatt

SEQ ID NO: 25898 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
acgctttaaagcaaaaaagt

SEQ ID NO: 25899 - DNA, 20 bp, Artificial Sequence
  Description of Artificial Sequence: Synthetic oligonucleotide
  Target: ATXN1; (-) strand; PAM type: NNNNGHTT; PAM sequence: CTACGCTT
ggtagctaacctggaatgca

SEQ ID NO: 25900 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
ctaaataggacagtggatgt

SEQ ID NO: 25901 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
taggtggtttggggtaaagc

SEQ ID NO: 25902 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
ttttaaaaatggataacata

SEQ ID NO: 25903 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
cgcctcagcctcctaaagtg

SEQ ID NO: 25904 - DNA, 20 bp, Artificial Sequence
  Description of Artificial Sequence: Synthetic oligonucleotide
  Target: ATXN1; (-) strand; PAM type: NNNNGHTT; PAM sequence: ACAGGATT
tttttgtatttttagtagag

SEQ ID NO: 25905 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctccgcctcctgggttc

SEQ ID NO: 25906 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
attcttccccattttaaagg

SEQ ID NO: 25907 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
atcactgagaattcatgagg

SEQ ID NO: 25908 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
ttgatagtttgaaggtgttg

SEQ ID NO: 25909 - DNA, 20 bp, Artificial Sequence
  Description of Artificial Sequence: Synthetic oligonucleotide
  Target: ATXN1; (-) strand; PAM type: NNNNGHTT; PAM sequence: GATAGTTT
aacagatgtttgaaagaatt

SEQ ID NO: 25910 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
cacagatgtgaggaaaaaac

SEQ ID NO: 25911 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
gcgtctgagctttctgttta

SEQ ID NO: 25912 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
ttgagtttagcgtctgagct

SEQ ID NO: 25913 - DNA, 20 bp, Artificial Sequence
  Description of Artificial Sequence: Synthetic oligonucleotide
  Target: ATXN1; (-) strand; PAM type: NNNNGHTT; PAM sequence: CTGAGCTT
gccatccttgagtttagcgt

SEQ ID NO: 25914 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
cttccctggaaatgccatcc

SEQ ID NO: 25915 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
cttccctgcgggatgtggaa

SEQ ID NO: 25916 - DNA, 20 bp, Artificial Sequence
  Description of Artificial Sequence: Synthetic oligonucleotide
  Target: ATXN1; (-) strand; PAM type: NNNNGHTT; PAM sequence: TGGCGCTT
aggcctcctggagcagttgc

SEQ ID NO: 25917 - DNA, 20 bp, Artificial Sequence
  Description of Artificial Sequence: Synthetic oligonucleotide
  Target: ATXN1; (-) strand; PAM type: NNNNGHTT; PAM sequence: GAGAGTTT
acctttttcctgacttgatg

SEQ ID NO: 25918 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
cagccacaccaaggacagtg

SEQ ID NO: 25919 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
gaattatctggaggcattgg

SEQ ID NO: 25920 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
tttatgaattatctggaggc

SEQ ID NO: 25921 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
gacacctggaggaacagctg

SEQ ID NO: 25922 - DNA, 20 bp, Artificial Sequence
  Description of Artificial Sequence: Synthetic oligonucleotide
  Target: ATXN1; (-) strand; PAM type: NNNNGHTT; PAM sequence: CTGAGCTT
ttaggcaagtgacttacact

SEQ ID NO: 25923 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
tcatattaggattttttgtg

SEQ ID NO: 25924 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
ctagatcccaagttttcata

SEQ ID NO: 25925 - DNA, 20 bp, Artificial Sequence
  Description of Artificial Sequence: Synthetic oligonucleotide
  Target: ATXN1; (-) strand; PAM type: NNNNGHTT; PAM sequence: CCAAGTTT
cacaacccaagaactagatc

SEQ ID NO: 25926 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
ttggaaggctgaggcaggag

SEQ ID NO: 25927 - DNA, 20 bp, Artificial Sequence
  Description of Artificial Sequence: Synthetic oligonucleotide
  Target: ATXN1; (-) strand; PAM type: NNNNGHTT; PAM sequence: CCCAGCTT
tggtggcatgcgcctgtagt

SEQ ID NO: 25928 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
ggtgggggcaaaggccagac

SEQ ID NO: 25929 - DNA, 20 bp, Artificial Sequence
  Description of Artificial Sequence: Synthetic oligonucleotide
  Target: ATXN1; (-) strand; PAM type: NNNNGHTT; PAM sequence: TAGAGTTT
ctcacgcgaacctcagcatc

SEQ ID NO: 25930 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
ggtctagaggggtccagaca

SEQ ID NO: 25931 - DNA, 20 bp, Artificial Sequence
  Description of Artificial Sequence: Synthetic oligonucleotide
  Target: ATXN1; (-) strand; PAM type: NNNNGHTT; PAM sequence: CTCCGTTT
agggggtttcccagaccacc

SEQ ID NO: 25932 - DNA, 20 bp, Artificial Sequence
  Description of Artificial Sequence: Synthetic oligonucleotide
  Target: ATXN1; (-) strand; PAM type: NNNNGHTT; PAM sequence: GGGGGTTT
caccacgaattgcaagttca

SEQ ID NO: 25933 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
ccaatttagattaacctaat

SEQ ID NO: 25934 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
cacagtttggggtataccaa

SEQ ID NO: 25935 - DNA, 20 bp, Artificial Sequence
  Description of Artificial Sequence: Synthetic oligonucleotide
  Target: ATXN1; (-) strand; PAM type: NNNNGHTT; PAM sequence: CACAGTTT
ccatctgcctgttccctggc

SEQ ID NO: 25936 - DNA, 20 bp, Artificial Sequence
  Description of Artificial Sequence: Synthetic oligonucleotide
  Target: ATXN1; (-) strand; PAM type: NNNNGHTT; PAM sequence: GGAGGCTT
cattggggagatttccacag

SEQ ID NO: 25937 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
cttacatgtatgtgccattg

SEQ ID NO: 25938 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
accccaaaaattgatccact

SEQ ID NO: 25939 - DNA, 20 bp, Artificial Sequence
  Description of Artificial Sequence: Synthetic oligonucleotide
  Target: ATXN1; (-) strand; PAM type: NNNNGHTT; PAM sequence: GGTAGATT
tgggatgttcagtattctat

SEQ ID NO: 25940 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
tgagtctgatgtgccgtcag

SEQ ID NO: 25941 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
gtctggggtagatctggaca

SEQ ID NO: 25942 - DNA, 20 bp, Artificial Sequence
  Description of Artificial Sequence: Synthetic oligonucleotide
  Target: ATXN1; (-) strand; PAM type: NNNNGHTT; PAM sequence: TAGGGATT
ccagtggtggtcccaacatc

SEQ ID NO: 25943 - DNA, 20 bp, Artificial Sequence
  Description of Artificial Sequence: Synthetic oligonucleotide
  Target: ATXN1; (-) strand; PAM type: NNNNGHTT; PAM sequence: TGGAGCTT
aatggtgtgaacccgggagg

SEQ ID NO: 25944 - DNA, 20 bp, Artificial Sequence
  Description of Artificial Sequence: Synthetic oligonucleotide
  Target: ATXN1; (-) strand; PAM type: NNNNGHTT; PAM sequence: GGGGGCTT
gccaaggacagatggagtta

SEQ ID NO: 25945 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
gtaggtggatcgctcaggtc

SEQ ID NO: 25946 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
ttgtgttggcaaagtgggga

SEQ ID NO: 25947 - DNA, 20 bp, Artificial Sequence
  Description of Artificial Sequence: Synthetic oligonucleotide
  Target: ATXN1; (-) strand; PAM type: NNNNGHTT; PAM sequence: GTATGATT
gacatagcatataattttaa

SEQ ID NO: 25948 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cttgctattttccatttttg

SEQ ID NO: 25949 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
caacacttgctattttccat

SEQ ID NO: 25950 - DNA, 20 bp, Artificial Sequence
  Description of Artificial Sequence: Synthetic oligonucleotide
  Target: ATXN1; (-) strand; PAM type: NNNNGHTT; PAM sequence: TCTCGTTT
caccaacgatgcacataggt

SEQ ID NO: 25951 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
cacattttgaggaactgcca

SEQ ID NO: 25952 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
aatatctgagtccctgcttt

SEQ ID NO: 25953 - DNA, 20 bp, Artificial Sequence
  Description of Artificial Sequence: Synthetic oligonucleotide
  Target: ATXN1; (-) strand; PAM type: NNNNGHTT; PAM sequence: CCCTGCTT
cgggtgtggaatatctgagt

SEQ ID NO: 25954 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
ataaggatataccacatttt

SEQ ID NO: 25955 - DNA, 20 bp, Artificial Sequence
  Description of Artificial Sequence: Synthetic oligonucleotide
  Target: ATXN1; (-) strand; PAM type: NNNNGHTT; PAM sequence: TGAAGATT
ctttcacttagcataatgtt

SEQ ID NO: 25956 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
ctggcttctttcacttagca

SEQ ID NO: 25957 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
tatgatattgttcttttgtg

SEQ ID NO: 25958 - DNA, 20 bp, Artificial Sequence
  Description of Artificial Sequence: Synthetic oligonucleotide
  Target: ATXN1; (-) strand; PAM type: NNNNGHTT; PAM sequence: TCTAGATT
ctctctccaaatttgactat

SEQ ID NO: 25959 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
atcaccaccatctgtctcca

SEQ ID NO: 25960 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgcctcagcctcccaaagtg

SEQ ID NO: 25961 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
tttctattttttagtagaga

SEQ ID NO: 25962 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
gtgtggtttcaaaacagaaa

SEQ ID NO: 25963 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
gatgagggagcggggcgctg

SEQ ID NO: 25964 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
gagaaagggcatacagcttt

SEQ ID NO: 25965 - DNA, 20 bp, Artificial Sequence
  Description of Artificial Sequence: Synthetic oligonucleotide
  Target: ATXN1; (-) strand; PAM type: NNNNGHTT; PAM sequence: TACAGCTT
tgcggatgtgagaaagggca

SEQ ID NO: 25966 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
agaggcatacagggatatcg

SEQ ID NO: 25967 - DNA, 20 bp, Artificial Sequence
  Description of Artificial Sequence: Synthetic oligonucleotide
  Target: ATXN1; (-) strand; PAM type: NNNNGHTT; PAM sequence: CCCTGATT
catcgtcaaggttttccagt

SEQ ID NO: 25968 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
actaggtggccgcgcatcgt

SEQ ID NO: 25969 - DNA, 20 bp, Artificial Sequence
  Description of Artificial Sequence: Synthetic oligonucleotide
  Target: ATXN1; (-) strand; PAM type: NNNNGHTT; PAM sequence: ACACGATT
ggtgtatggcccgcaaagcc

SEQ ID NO: 25970 - DNA, 20 bp, Artificial Sequence
  Description of Artificial Sequence: Synthetic oligonucleotide
  Target: ATXN1; (-) strand; PAM type: NNNNGHTT; PAM sequence: GGTTGCTT
actggttacaaattatctgt

SEQ ID NO: 25971 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
aggcctgcagcaggcatatt

SEQ ID NO: 25972 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
acctgaaagatgggtgaggc

SEQ ID NO: 25973 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
cctctccaagcccatgaccc

SEQ ID NO: 25974 - DNA, 20 bp, Artificial Sequence
  Description of Artificial Sequence: Synthetic oligonucleotide
  Target: ATXN1; (-) strand; PAM type: NNNNGHTT; PAM sequence: CCCAGATT
agctgattagattgtgccca

SEQ ID NO: 25975 - DNA, 20 bp, Artificial Sequence
  Description of Artificial Sequence: Synthetic oligonucleotide
  Target: ATXN1; (-) strand; PAM type: NNNNGHTT; PAM sequence: ATTAGATT
tctagcctcactggcagctg

SEQ ID NO: 25976 - DNA, 20 bp, Artificial Sequence
  Description of Artificial Sequence: Synthetic oligonucleotide
  Target: ATXN1; (-) strand; PAM type: NNNNGHTT; PAM sequence: AGCTGATT
ttcattctagcctcactggc

SEQ ID NO: 25977 - DNA, 20 bp, Artificial Sequence
  Description of Artificial Sequence: Synthetic oligonucleotide
  Target: ATXN1; (-) strand; PAM type: NNNNGHTT; PAM sequence: GCCTGCTT
tagtccttctacgttcttct

SEQ ID NO: 25978 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
ggatagatgtatatatgaag

SEQ ID NO: 25979 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
tggctttgctgagagtttag

SEQ ID NO: 25980 - DNA, 20 bp, Artificial Sequence
  Description of Artificial Sequence: Synthetic oligonucleotide
  Target: ATXN1; (-) strand; PAM type: NNNNGHTT; PAM sequence: GAGAGTTT
cagccggaagtggctttgct

SEQ ID NO: 25981 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
caaggattgcagcagccgga

SEQ ID NO: 25982 - DNA, 20 bp, Artificial Sequence
  Description of Artificial Sequence: Synthetic oligonucleotide
  Target: ATXN1; (-) strand; PAM type: NNNNGHTT; PAM sequence: CAAGGATT
atgacgaaaacacgtgaaaa

SEQ ID NO: 25983 - DNA, 20 bp, Artificial Sequence
  Description of Artificial Sequence: Synthetic oligonucleotide
  Target: ATXN1; (-) strand; PAM type: NNNNGHTT; PAM sequence: CGGAGTTT
cttcagtctctaagcagcat

SEQ ID NO: 25984 - DNA, 20 bp, Artificial Sequence
  Description of Artificial Sequence: Synthetic oligonucleotide
  Target: ATXN1; (-) strand; PAM type: NNNNGHTT; PAM sequence: ACCAGCTT
aaatcctttgccttttaata

SEQ ID NO: 25985 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
ttatgtccctccgtaatgag

SEQ ID NO: 25986 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
tttgaaatggaatctcaagg

SEQ ID NO: 25987 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
taataatctcacgtgagaaa

SEQ ID NO: 25988 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
agttttggataattggatat

SEQ ID NO: 25989 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
tgagcctaagacaatcttta

SEQ ID NO: 25990 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
gagactaccgaggtgtttcc

SEQ ID NO: 25991 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
agtaaatccagagactaccg

SEQ ID NO: 25992 - DNA, 20 bp, Artificial Sequence
  Description of Artificial Sequence: Synthetic oligonucleotide
  Target: ATXN1; (-) strand; PAM type: NNNNGHTT; PAM sequence: GCTGGTTT
ccttcctacgattgatttag

SEQ ID NO: 25993 - DNA, 20 bp, Artificial Sequence
  Description of Artificial Sequence: Synthetic oligonucleotide
  Target: ATXN1; (-) strand; PAM type: NNNNGHTT; PAM sequence: GATTGATT
gatctccttgtccttcctac

SEQ ID NO: 25994 - DNA, 20 bp, Artificial Sequence
  Description of Artificial Sequence: Synthetic oligonucleotide
  Target: ATXN1; (-) strand; PAM type: NNNNGHTT; PAM sequence: CTACGATT
agctgatctccttgtccttc

SEQ ID NO: 25995 - DNA, 20 bp, Artificial Sequence
  Description of Artificial Sequence: Synthetic oligonucleotide
  Target: ATXN1; (-) strand; PAM type: NNNNGHTT; PAM sequence: CTGGGCTT
gaaagtaggcttcccacttg

SEQ ID NO: 25996 - DNA, 20 bp, Artificial Sequence
  Description of Artificial Sequence: Synthetic oligonucleotide
  Target: ATXN1; (-) strand; PAM type: NNNNGHTT; PAM sequence: GTAGGCTT
gaagtcagtggaggtagaaa

SEQ ID NO: 25997 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
aggagaggctgctgtaatta

SEQ ID NO: 25998 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
ttcagtgtccttaatgttcc

SEQ ID NO: 25999 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
agtttggcagcccaatgctg

SEQ ID NO: 26000 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
cgctgagctgggggaggagg

SEQ ID NO: 26001 - DNA, 20 bp, Artificial Sequence
  Description of Artificial Sequence: Synthetic oligonucleotide
  Target: ATXN1; (-) strand; PAM type: NNNNGHTT; PAM sequence: ACCTGATT
tttttttttattgaatgaat

SEQ ID NO: 26002 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
tcaggaggctgaggcatgag

SEQ ID NO: 26003 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgggcggatcacctgaggtc

SEQ ID NO: 26004 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
tccaaggattactgcataga

SEQ ID NO: 26005 - DNA, 20 bp, Artificial Sequence
  Description of Artificial Sequence: Synthetic oligonucleotide
  Target: ATXN1; (-) strand; PAM type: NNNNGHTT; PAM sequence: CAAGGATT
cctctcttccactgcatgtc

SEQ ID NO: 26006 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
ctaaatgcaaagagggagca

SEQ ID NO: 26007 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
agaacgatattatcaagtgt

SEQ ID NO: 26008 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
aacatgacactgaatcaact

SEQ ID NO: 26009 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
ccaccagactcaggagccca

SEQ ID NO: 26010 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
accttgagctagatatagag

SEQ ID NO: 26011 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
tagacacagggtgctgattg

SEQ ID NO: 26012 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
accctgagctagacacaggg

SEQ ID NO: 26013 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
cagagtagctagttacagag

SEQ ID NO: 26014 - DNA, 20 bp, Artificial Sequence
  Description of Artificial Sequence: Synthetic oligonucleotide
  Target: ATXN1; (-) strand; PAM type: NNNNGHTT; PAM sequence: TGCCGATT
accttgagctagatacagag

SEQ ID NO: 26015 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
tagacacagggtgctgattg

SEQ ID NO: 26016 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
accctgagctagacacaggg

SEQ ID NO: 26017 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
cagagtagctagatacagag

SEQ ID NO: 26018 - DNA, 20 bp, Artificial Sequence
  Description of Artificial Sequence: Synthetic oligonucleotide
  Target: ATXN1; (-) strand; PAM type: NNNNGHTT; PAM sequence: ACTAGATT
caaaggttctccagggcccc

SEQ ID NO: 26019 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
agtggtctgttttgacaggg

SEQ ID NO: 26020 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
attttacagagagcccagtg

SEQ ID NO: 26021 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
atctggccctacccatgttc

SEQ ID NO: 26022 - DNA, 20 bp, Artificial Sequence
  Description of Artificial Sequence: Synthetic oligonucleotide
  Target: ATXN1; (-) strand; PAM type: NNNNGHTT; PAM sequence: GCCTGCTT
taccactgctggctcgggca

SEQ ID NO: 26023 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
tattgcaaagacaaaaagaa

SEQ ID NO: 26024 - DNA, 20 bp, Artificial Sequence
  Description of Artificial Sequence: Synthetic oligonucleotide
  Target: ATXN1; (-) strand; PAM type: NNNNGHTT; PAM sequence: GCAAGATT
ccaaagagtgaacagcagca

SEQ ID NO: 26025 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
ccctgtgggttcatggtctc

SEQ ID NO: 26026 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
atgaaaccctatctgaataa

SEQ ID NO: 26027 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgggaggatcgcttaagccc

SEQ ID NO: 26028 - DNA, 20 bp, Artificial Sequence
  Description of Artificial Sequence: Synthetic oligonucleotide
  Target: ATXN1; (-) strand; PAM type: NNNNGHTT; PAM sequence: GATCGCTT
atggaaagccaaaatgggag

SEQ ID NO: 26029 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
cattttcttaaagaggaaat

SEQ ID NO: 26030 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cccctcggcctctgaaagtg

SEQ ID NO: 26031 - DNA, 20 bp, Artificial Sequence
  Description of Artificial Sequence: Synthetic oligonucleotide
  Target: ATXN1; (-) strand; PAM type: NNNNGHTT; PAM sequence: CGGGGCTT
ttttgtatttttagtagaga

SEQ ID NO: 26032 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctccacctcgcgggttc

SEQ ID NO: 26033 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
tcatttttttttttctaagg

SEQ ID NO: 26034 - DNA, 20 bp, Artificial Sequence
  Description of Artificial Sequence: Synthetic oligonucleotide
  Target: ATXN1; (-) strand; PAM type: NNNNGHTT; PAM sequence: GCCTGCTT
gcattttttgaggcactact

SEQ ID NO: 26035 - DNA, 20 bp, Artificial Sequence
  Description of Artificial Sequence: Synthetic oligonucleotide
  Target: ATXN1; (-) strand; PAM type: NNNNGHTT; PAM sequence: GGTAGTTT
ttgctgcagcagtcatagga

SEQ ID NO: 26036 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
tggcctagatcccaggcctg

SEQ ID NO: 26037 - DNA, 20 bp, Artificial Sequence
  Description of Artificial Sequence: Synthetic oligonucleotide
  Target: ATXN1; (-) strand; PAM type: NNNNGHTT; PAM sequence: CCAGGATT
acagctgaggagtaaggcca

SEQ ID NO: 26038 - DNA, 20 bp, Artificial Sequence
  Description of Artificial Sequence: Synthetic oligonucleotide
  Target: ATXN1; (-) strand; PAM type: NNNNGHTT; PAM sequence: ATGTGATT
ccaccatgcccagcctgaaa

SEQ ID NO: 26039 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
agcctcagcctcccaaagtg

SEQ ID NO: 26040 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctctgcctcccgggttc

SEQ ID NO: 26041 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
aaagaattctagggaggaaa

SEQ ID NO: 26042 - DNA, 20 bp, Artificial Sequence
  Description of Artificial Sequence: Synthetic oligonucleotide
  Target: ATXN1; (-) strand; PAM type: NNNNGHTT; PAM sequence: GAGAGATT
gaggcagggaaacttttaat

SEQ ID NO: 26043 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
ttctgcaaacaaggctttgg

SEQ ID NO: 26044 - DNA, 20 bp, Artificial Sequence
  Description of Artificial Sequence: Synthetic oligonucleotide
  Target: ATXN1; (-) strand; PAM type: NNNNGHTT; PAM sequence: CAAGGCTT
ttgaccatttgttctgcaaa

SEQ ID NO: 26045 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
ttctgcgttcaaataagcca

SEQ ID NO: 26046 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
ggtattctaaaaaggaaaag

SEQ ID NO: 26047 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
tttatgtttttataatgttg

SEQ ID NO: 26048 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
attaaatcgttagtcatatt

SEQ ID NO: 26049 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
attaaatattttattgcctg

SEQ ID NO: 26050 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
tgtccattaaatattttatt

SEQ ID NO: 26051 - DNA, 20 bp, Artificial Sequence
  Description of Artificial Sequence: Synthetic oligonucleotide
  Target: ATXN1; (-) strand; PAM type: NNNNGHTT; PAM sequence: TTCCGCTT
ctgccttactttttttgcat

SEQ ID NO: 26052 - DNA, 20 bp, Artificial Sequence
  Description of Artificial Sequence: Synthetic oligonucleotide
  Target: ATXN1; (-) strand; PAM type: NNNNGHTT; PAM sequence: ATGAGCTT
ccacagtgctagtatagaaa

SEQ ID NO: 26053 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
catattccagatgaggaaac

SEQ ID NO: 26054 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
tttcttatgctaggcattat

SEQ ID NO: 26055 - DNA, 20 bp, Artificial Sequence
  Description of Artificial Sequence: Synthetic oligonucleotide
  Target: ATXN1; (-) strand; PAM type: NNNNGHTT; PAM sequence: CCTGGATT
agttcaggaagaagaacaca

SEQ ID NO: 26056 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
aaatatggaaccggagtgca

SEQ ID NO: 26057 - DNA, 20 bp, Artificial Sequence
  Description of Artificial Sequence: Synthetic oligonucleotide
  Target: ATXN1; (-) strand; PAM type: NNNNGHTT; PAM sequence: CTATGCTT
atcaaatatcaggctctggc

SEQ ID NO: 26058 - DNA, 20 bp, Artificial Sequence
  Description of Artificial Sequence: Synthetic oligonucleotide
  Target: ATXN1; (-) strand; PAM type: NNNNGHTT; PAM sequence: TCAAGCTT
atatgggaaaaagagagact

SEQ ID NO: 26059 - DNA, 20 bp, Artificial Sequence
  Description of Artificial Sequence: Synthetic oligonucleotide
  Target: ATXN1; (-) strand; PAM type: NNNNGHTT; PAM sequence: CGGTGATT
aggaaaccaaggcttgggtt

SEQ ID NO: 26060 - DNA, 20 bp, Artificial Sequence
  Description of Artificial Sequence: Synthetic oligonucleotide
  Target: ATXN1; (-) strand; PAM type: NNNNGHTT; PAM sequence: CAAGGCTT
ccattttaaaatgaggaaac

SEQ ID NO: 26061 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcggcctcctgaagtg

SEQ ID NO: 26062 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
gtgccgcgatctcagctcaa

SEQ ID NO: 26063 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
taaagttcctgctgaataag

SEQ ID NO: 26064 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
aaacattcactgggggaaaa

SEQ ID NO: 26065 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
gcctgtatgacagagtgaga

SEQ ID NO: 26066 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
gaggtcgaagctacagtgag

SEQ ID NO: 26067 - DNA, 20 bp, Artificial Sequence
  Description of Artificial Sequence: Synthetic oligonucleotide
  Target: ATXN1; (-) strand; PAM type: NNNNGHTT; PAM sequence: GATGGCTT
tcaagaggcagaggtgggtg

SEQ ID NO: 26068 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
gctgcgatactgaaaggagg

SEQ ID NO: 26069 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
taccgtcagcacacatctgg

SEQ ID NO: 26070 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
gatgtttttctgatggaagc

SEQ ID NO: 26071 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
catttatctacttaacactc

SEQ ID NO: 26072 - DNA, 20 bp, Artificial Sequence
  Description of Artificial Sequence: Synthetic oligonucleotide
  Target: ATXN1; (-) strand; PAM type: NNNNGHTT; PAM sequence: CCAAGTTT
actatagcagggaaaaagat

SEQ ID NO: 26073 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
agactcagtcactgccttat

SEQ ID NO: 26074 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
atcttctacgttggaaacgt

SEQ ID NO: 26075 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
ttctttgtatattttcccaa

SEQ ID NO: 26076 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
gtcccttcaggctctccgtt

SEQ ID NO: 26077 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
attactcatgcctggctgtt

SEQ ID NO: 26078 - DNA, 20 bp, Artificial Sequence
  Description of Artificial Sequence: Synthetic oligonucleotide
  Target: ATXN1; (-) strand; PAM type: NNNNGHTT; PAM sequence: GGAAGTTT
tcttctacagtgtcattgag

SEQ ID NO: 26079 - DNA, 20 bp, Artificial Sequence
  Description of Artificial Sequence: Synthetic oligonucleotide
  Target: ATXN1; (-) strand; PAM type: NNNNGHTT; PAM sequence: ATGCGTTT
gtgaggaagcttgtaaatcc

SEQ ID NO: 26080 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
ctctgtcggcttgagtgtga

SEQ ID NO: 26081 - DNA, 20 bp, Artificial Sequence
  Description of Artificial Sequence: Synthetic oligonucleotide
  Target: ATXN1; (-) strand; PAM type: NNNNGHTT; PAM sequence: GTCGGCTT
agagcctcgtgtgatgctct

SEQ ID NO: 26082 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
atctgacaataactctgcca

SEQ ID NO: 26083 - DNA, 20 bp, Artificial Sequence
  Description of Artificial Sequence: Synthetic oligonucleotide
  Target: ATXN1; (-) strand; PAM type: NNNNGHTT; PAM sequence: GTGGGTTT
atagggtttggtactatcca

SEQ ID NO: 26084 - DNA, 20 bp, Artificial Sequence
  Description of Artificial Sequence: Synthetic oligonucleotide
  Target: ATXN1; (-) strand; PAM type: NNNNGHTT; PAM sequence: TAGGGTTT
ggaaaaaaacatagcgtaca

SEQ ID NO: 26085 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
gatccactgtggtgggatgg

SEQ ID NO: 26086 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
gagtcacctagcggccatct

SEQ ID NO: 26087 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
agacgtgaatcgtccctttc

SEQ ID NO: 26088 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
attccagaaataaacagttc

SEQ ID NO: 26089 - DNA, 20 bp, Artificial Sequence
  Description of Artificial Sequence: Synthetic oligonucleotide
  Target: ATXN1; (-) strand; PAM type: NNNNGHTT; PAM sequence: GGTTGATT
gacgtcccccgttatccgca

SEQ ID NO: 26090 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
agccttgttgagacacctcc

SEQ ID NO: 26091 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
attctatgagcgcttttcct

SEQ ID NO: 26092 - DNA, 20 bp, Artificial Sequence
  Description of Artificial Sequence: Synthetic oligonucleotide
  Target: ATXN1; (-) strand; PAM type: NNNNGHTT; PAM sequence: GAGCGCTT
agcagcattccccattctat

SEQ ID NO: 26093 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
caccatgccgggcctcctgt

SEQ ID NO: 26094 - DNA, 20 bp, Artificial Sequence
  Description of Artificial Sequence: Synthetic oligonucleotide
  Target: ATXN1; (-) strand; PAM type: NNNNGHTT; PAM sequence: GGGGGTTT
tttgtagttttagtagagac

SEQ ID NO: 26095 - DNA, 20 bp, Artificial Sequence
  Description of Artificial Sequence: Synthetic oligonucleotide
  Target: ATXN1; (-) strand; PAM type: NNNNGHTT; PAM sequence: TGTAGTTT
caccatgcctggctaatttt

SEQ ID NO: 26096 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
tgcctcagcctcctgagtag

SEQ ID NO: 26097 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctccgcctcccaggttc

SEQ ID NO: 26098 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tgtaattgtggttttttgtt

SEQ ID NO: 26099 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gtgtgtttgtaattgtggtt

SEQ ID NO: 26100 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
tggccaagtgtgtttgtaat

SEQ ID NO: 26101 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
gcttcaagtttaatggccaa

SEQ ID NO: 26102 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
cgaagctgtttttcactgct

SEQ ID NO: 26103 - DNA, 20 bp, Artificial Sequence
  Description of Artificial Sequence: Synthetic oligonucleotide
  Target: ATXN1; (-) strand; PAM type: NNNNGHTT; PAM sequence: CACTGCTT
tcgtagacgaagctgttttt

SEQ ID NO: 26104 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
ttatttattctcgtagacga

SEQ ID NO: 26105 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
tcttaaagcataatgcctgt

SEQ ID NO: 26106 - DNA, 20 bp, Artificial Sequence
  Description of Artificial Sequence: Synthetic oligonucleotide
  Target: ATXN1; (-) strand; PAM type: NNNNGHTT; PAM sequence: GCACGATT
cctcactgtaatgtcctcat

SEQ ID NO: 26107 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
ttttacagcatcacatgtat

SEQ ID NO: 26108 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
accaaaagagatttttaaaa

SEQ ID NO: 26109 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
ctgccaatcagaatcaccaa

SEQ ID NO: 26110 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
agacttttcaaaatctttcc

SEQ ID NO: 26111 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
agggaactgagggtccactg

SEQ ID NO: 26112 - DNA, 20 bp, Artificial Sequence
  Description of Artificial Sequence: Synthetic oligonucleotide
  Target: ATXN1; (-) strand; PAM type: NNNNGHTT; PAM sequence: CACTGTTT
tctggctttattgtggaggg

SEQ ID NO: 26113 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
ataagatagaaggaaggggg

SEQ ID NO: 26114 - DNA, 20 bp, Artificial Sequence
  Description of Artificial Sequence: Synthetic oligonucleotide
  Target: ATXN1; (-) strand; PAM type: NNNNGHTT; PAM sequence: CCGAGATT
gaggcagaggttgcagtgag

SEQ ID NO: 26115 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
tagagaggctgaggcaggag

SEQ ID NO: 26116 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
ggcaggtagatcaggaggtc

SEQ ID NO: 26117 - DNA, 20 bp, Artificial Sequence
  Description of Artificial Sequence: Synthetic oligonucleotide
  Target: ATXN1; (-) strand; PAM type: NNNNGHTT; PAM sequence: CCCAGCTT
caaacaaattccatgtgtaa

SEQ ID NO: 26118 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
attttgttttctgggaaaag

SEQ ID NO: 26119 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
actcgattttgttttctggg

SEQ ID NO: 26120 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ctttgtttaaaaggactcga

SEQ ID NO: 26121 - DNA, 20 bp, Artificial Sequence
  Description of Artificial Sequence: Synthetic oligonucleotide
  Target: ATXN1; (-) strand; PAM type: NNNNGHTT; PAM sequence: ACTCGATT
taaaaactttgtttaaaagg

SEQ ID NO: 26122 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
atcctctaaatatctaaaaa

SEQ ID NO: 26123 - DNA, 20 bp, Artificial Sequence
  Description of Artificial Sequence: Synthetic oligonucleotide
  Target: ATXN1; (-) strand; PAM type: NNNNGHTT; PAM sequence: TAGAGTTT
atggctgctgctccactctg

SEQ ID NO: 26124 - DNA, 20 bp, Artificial Sequence
  Description of Artificial Sequence: Synthetic oligonucleotide
  Target: ATXN1; (-) strand; PAM type: NNNNGHTT; PAM sequence: CCTAGTTT
cttccttctgttttatgcag

SEQ ID NO: 26125 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
aagatggctgtggaccttcc

SEQ ID NO: 26126 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
tggttttaggtgctctgtat

SEQ ID NO: 26127 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
cactactggttttaggtgcc

SEQ ID NO: 26128 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
cgtaaaattggattaccact

SEQ ID NO: 26129 - DNA, 20 bp, Artificial Sequence
  Description of Artificial Sequence: Synthetic oligonucleotide
  Target: ATXN1; (-) strand; PAM type: NNNNGHTT; PAM sequence: ATTGGATT
ctgctgcagttttccgtaaa

SEQ ID NO: 26130 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
aggtggcagcaaattcctgc

SEQ ID NO: 26131 - DNA, 20 bp, Artificial Sequence
  Description of Artificial Sequence: Synthetic oligonucleotide
  Target: ATXN1; (-) strand; PAM type: NNNNGHTT; PAM sequence: CTTCGCTT
gacactgctcttgtttgtgt

SEQ ID NO: 26132 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tccatcagggtcgacactgc

SEQ ID NO: 26133 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
tgtcatccctttcttatcca

SEQ ID NO: 26134 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
tgagtattcctgcaggaagg

SEQ ID NO: 26135 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
tcaggaggctgaggcaggag

SEQ ID NO: 26136 - DNA, 20 bp, Artificial Sequence
  Description of Artificial Sequence: Synthetic oligonucleotide
  Target: ATXN1; (-) strand; PAM type: NNNNGHTT; PAM sequence: ACGTGTTT
gaagtggtggttggagcaag

SEQ ID NO: 26137 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
cccagagtcagcccttcatc

SEQ ID NO: 26138 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
cagagataggaaattcagac

SEQ ID NO: 26139 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
aagagaggacatcacttctt

SEQ ID NO: 26140 - DNA, 20 bp, Artificial Sequence
  Description of Artificial Sequence: Synthetic oligonucleotide
  Target: ATXN1; (-) strand; PAM type: NNNNGHTT; PAM sequence: TGAGGTTT
cctgtgccacgattttttac

SEQ ID NO: 26141 - DNA, 20 bp, Artificial Sequence
  Description of Artificial Sequence: Synthetic oligonucleotide
  Target: ATXN1; (-) strand; PAM type: NNNNGHTT; PAM sequence: CCACGATT
aagaaaatccgtgacctgtg

SEQ ID NO: 26142 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
ggccaaattaggtcaaaaac

SEQ ID NO: 26143 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
acagccctgttccatttctt

SEQ ID NO: 26144 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
ccataacattgccaacagca

SEQ ID NO: 26145 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
acaattatgtgagcctcaac

SEQ ID NO: 26146 - DNA, 20 bp, Artificial Sequence
  Description of Artificial Sequence: Synthetic oligonucleotide
  Target: ATXN1; (-) strand; PAM type: NNNNGHTT; PAM sequence: GGCAGCTT
ggacagttcatactgttctt

SEQ ID NO: 26147 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
tttcctggtatcatttgtcc

SEQ ID NO: 26148 - DNA, 20 bp, Artificial Sequence
  Description of Artificial Sequence: Synthetic oligonucleotide
  Target: ATXN1; (-) strand; PAM type: NNNNGHTT; PAM sequence: AACGGCTT
ttttcccccaaagaatttca

SEQ ID NO: 26149 - DNA, 20 bp, Artificial Sequence
  Description of Artificial Sequence: Synthetic oligonucleotide
  Target: ATXN1; (-) strand; PAM type: NNNNGHTT; PAM sequence: ATATGCTT
cagggtggtctgcataagtt

SEQ ID NO: 26150 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
aaagaagtttgtctagtatg

SEQ ID NO: 26151 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
ggaaagaaacgtggtccaaa

SEQ ID NO: 26152 - DNA, 20 bp, Artificial Sequence
  Description of Artificial Sequence: Synthetic oligonucleotide
  Target: ATXN1; (-) strand; PAM type: NNNNGHTT; PAM sequence: TCAAGCTT
tgaaaattagtttgctgtct

SEQ ID NO: 26153 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
gacaaatgcctaatttgaaa

SEQ ID NO: 26154 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
ctcaagattcatcttcctaa

SEQ ID NO: 26155 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
taatcaaaagtttgttttgc

SEQ ID NO: 26156 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
ttttttgaatataatcaaaa

SEQ ID NO: 26157 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
ggtgttttttgaatataatc

SEQ ID NO: 26158 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
ctagatctccagaatttttt

SEQ ID NO: 26159 - DNA, 20 bp, Artificial Sequence
  Description of Artificial Sequence: Synthetic oligonucleotide
  Target: ATXN1; (-) strand; PAM type: NNNNGHTT; PAM sequence: CCCTGCTT
atattagctttttatatgac

SEQ ID NO: 26160 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
ttgtcaccacagtcctccat

SEQ ID NO: 26161 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
atattactgtccgtattatg

SEQ ID NO: 26162 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
tgcataaattccatatagat

SEQ ID NO: 26163 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
tggaatttgcataaattcca

SEQ ID NO: 26164 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
tagtgcatatttgtctctag

SEQ ID NO: 26165 - DNA, 20 bp, Artificial Sequence
  Description of Artificial Sequence: Synthetic oligonucleotide
  Target: ATXN1; (-) strand; PAM type: NNNNGHTT; PAM sequence: AACCGCTT
tcaggaggctgaggcagaag

SEQ ID NO: 26166 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgggtggatcatttgaggtc

SEQ ID NO: 26167 - DNA, 20 bp, Artificial Sequence
  Description of Artificial Sequence: Synthetic oligonucleotide
  Target: ATXN1; (-) strand; PAM type: NNNNGHTT; PAM sequence: ATTGGATT
accctctgggaactgagctg

SEQ ID NO: 26168 - DNA, 20 bp, Artificial Sequence
  Description of Artificial Sequence: Synthetic oligonucleotide
  Target: ATXN1; (-) strand; PAM type: NNNNGHTT; PAM sequence: AGCTGATT
tctagaccctctgggaactg

SEQ ID NO: 26169 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
gccaattttttgtctctctt

SEQ ID NO: 26170 - DNA, 20 bp, Artificial Sequence
  Description of Artificial Sequence: Synthetic oligonucleotide
  Target: ATXN1; (-) strand; PAM type: NNNNGHTT; PAM sequence: CCCAGCTT
ctcccactcctttggttcaa

SEQ ID NO: 26171 - DNA, 20 bp, Artificial Sequence
  Description of Artificial Sequence: Synthetic oligonucleotide
  Target: ATXN1; (-) strand; PAM type: NNNNGHTT; PAM sequence: TCTAGCTT
gctttattatctgcccctcc

SEQ ID NO: 26172 - DNA, 20 bp, Artificial Sequence
  Description of Artificial Sequence: Synthetic oligonucleotide
  Target: ATXN1; (-) strand; PAM type: NNNNGHTT; PAM sequence: ACGAGCTT
gggtcttactatctttatta

SEQ ID NO: 26173 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
gtcctttcaggagagttcct

SEQ ID NO: 26174 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
gcttccctcccgggtactgg

SEQ ID NO: 26175 - DNA, 20 bp, Artificial Sequence
  Description of Artificial Sequence: Synthetic oligonucleotide
  Target: ATXN1; (-) strand; PAM type: NNNNGHTT; PAM sequence: GTCAGCTT
tcttggatatttctcccagt

SEQ ID NO: 26176 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
aggtgtttgctcttcttgcc

SEQ ID NO: 26177 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
tctctaaccaaaattatggt

SEQ ID NO: 26178 - DNA, 20 bp, Artificial Sequence
  Description of Artificial Sequence: Synthetic oligonucleotide
  Target: ATXN1; (-) strand; PAM type: NNNNGHTT; PAM sequence: TCCCGTTT
caccagcaatgtaaaagtgt

SEQ ID NO: 26179 - DNA, 20 bp, Artificial Sequence
  Description of Artificial Sequence: Synthetic oligonucleotide
  Target: ATXN1; (-) strand; PAM type: NNNNGHTT; PAM sequence: CACTGTTT
agttctttaaggaatctcca

SEQ ID NO: 26180 - DNA, 20 bp, Artificial Sequence
  Description of Artificial Sequence: Synthetic oligonucleotide
  Target: ATXN1; (-) strand; PAM type: NNNNGHTT; PAM sequence: GTGGGATT
ctctgggtagatacccagta

SEQ ID NO: 26181 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
catacaataatttatccact

SEQ ID NO: 26182 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
ccactgccatcattacggtg

SEQ ID NO: 26183 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
tatgcagcaccagccgcgca

SEQ ID NO: 26184 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
tggccccaagagggcggggc

SEQ ID NO: 26185 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
gggagactcggatctacagc

SEQ ID NO: 26186 - DNA, 20 bp, Artificial Sequence
  Description of Artificial Sequence: Synthetic oligonucleotide
  Target: ATXN1; (-) strand; PAM type: NNNNGHTT; PAM sequence: GCCTGCTT
cccgcttgttcctggctcct

SEQ ID NO: 26187 - DNA, 20 bp, Artificial Sequence
  Description of Artificial Sequence: Synthetic oligonucleotide
  Target: ATXN1; (-) strand; PAM type: NNNNGHTT; PAM sequence: TCCCGCTT
caactcggaaggggcagggc

SEQ ID NO: 26188 - DNA, 20 bp, Artificial Sequence
  Description of Artificial Sequence: Synthetic oligonucleotide
  Target: ATXN1; (-) strand; PAM type: NNNNGHTT; PAM sequence: CGGGGCTT
cctgctgccattcatggccc

SEQ ID NO: 26189 - DNA, 20 bp, Artificial Sequence
  Description of Artificial Sequence: Synthetic oligonucleotide
  Target: ATXN1; (-) strand; PAM type: NNNNGHTT; PAM sequence: CAGGGCTT
ctgcctgctgtggctaagcc

SEQ ID NO: 26190 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
acatgtgaagggtgaaaaag

SEQ ID NO: 26191 - DNA, 20 bp, Artificial Sequence
  Description of Artificial Sequence: Synthetic oligonucleotide
  Target: ATXN1; (-) strand; PAM type: NNNNGHTT; PAM sequence: CCAAGTTT
ggccgcaacgccttttaagc

SEQ ID NO: 26192 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
ttgtgaggcctttgcatcct

SEQ ID NO: 26193 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
aagttcttcggtggtgattt

SEQ ID NO: 26194 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
tacatgaataagttcttcgg

SEQ ID NO: 26195 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
ataggttttgggggaacagg

SEQ ID NO: 26196 - DNA, 20 bp, Artificial Sequence
  Description of Artificial Sequence: Synthetic oligonucleotide
  Target: ATXN1; (-) strand; PAM type: NNNNGHTT; PAM sequence: ATAGGTTT
tatttttattttttacgtcc

SEQ ID NO: 26197 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
ccaatggccattcttagtct

SEQ ID NO: 26198 - DNA, 20 bp, Artificial Sequence
  Description of Artificial Sequence: Synthetic oligonucleotide
  Target: ATXN1; (-) strand; PAM type: NNNNGHTT; PAM sequence: CGGTGCTT
agtgtcttgtagaagctctc

SEQ ID NO: 26199 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
tttaatccagtgggcattaa

SEQ ID NO: 26200 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
tttgaagtcatctctgacca

SEQ ID NO: 26201 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
gcccatatgtttattcaagc

SEQ ID NO: 26202 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
agggcactttctcagagccc

SEQ ID NO: 26203 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
aagaggaacagtgttttcca

SEQ ID NO: 26204 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
gagggagcaaacaagaggaa

SEQ ID NO: 26205 - DNA, 20 bp, Artificial Sequence
  Description of Artificial Sequence: Synthetic oligonucleotide
  Target: ATXN1; (-) strand; PAM type: NNNNGHTT; PAM sequence: CTAAGATT
atatgttacgattagaggaa

SEQ ID NO: 26206 - DNA, 20 bp, Artificial Sequence
  Description of Artificial Sequence: Synthetic oligonucleotide
  Target: ATXN1; (-) strand; PAM type: NNNNGHTT; PAM sequence: TTACGATT
ctcctttctcactgaatatg

SEQ ID NO: 26207 - DNA, 20 bp, Artificial Sequence
  Description of Artificial Sequence: Synthetic oligonucleotide
  Target: ATXN1; (-) strand; PAM type: NNNNGHTT; PAM sequence: ACTGGATT
cttgtgtgtgtgttttctcc

SEQ ID NO: 26208 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
gtgtggacgtgggcttgtgt

SEQ ID NO: 26209 - DNA, 20 bp, Artificial Sequence
  Description of Artificial Sequence: Synthetic oligonucleotide
  Target: ATXN1; (-) strand; PAM type: NNNNGHTT; PAM sequence: GTGGGCTT
tctgaatgtgaggtgtggac

SEQ ID NO: 26210 - DNA, 20 bp, Artificial Sequence
  Description of Artificial Sequence: Synthetic oligonucleotide
  Target: ATXN1; (-) strand; PAM type: NNNNGHTT; PAM sequence: GCTAGTTT
aagtaaagactttctcactt

SEQ ID NO: 26211 - DNA, 20 bp, Artificial Sequence
  Description of Artificial Sequence: Synthetic oligonucleotide
  Target: ATXN1; (-) strand; PAM type: NNNNGHTT; PAM sequence: CACAGATT
atatagagccacacccctaa

SEQ ID NO: 26212 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
ggtacaatgtcctgcttgaa

SEQ ID NO: 26213 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
gaataccaaatggtacaatg

SEQ ID NO: 26214 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
ggcgtgtatgtgcaaaacat

SEQ ID NO: 26215 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
ggtgggcgtgtatgtgcaaa

SEQ ID NO: 26216 - DNA, 20 bp, Artificial Sequence
  Description of Artificial Sequence: Synthetic oligonucleotide
  Target: ATXN1; (-) strand; PAM type: NNNNGHTT; PAM sequence: TTACGTTT
tgcaagttttaggggacaag

SEQ ID NO: 26217 - DNA, 20 bp, Artificial Sequence
  Description of Artificial Sequence: Synthetic oligonucleotide
  Target: ATXN1; (-) strand; PAM type: NNNNGHTT; PAM sequence: GCAAGTTT
atgtcctttgatttgtttat

SEQ ID NO: 26218 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
aaatgctacaatgtcctttg

SEQ ID NO: 26219 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
actcgaaatgctacaatgtc

SEQ ID NO: 26220 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gcaagttaagttgagagtca

SEQ ID NO: 26221 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
tgggggattgtaggaggagg

SEQ ID NO: 26222 - DNA, 20 bp, Artificial Sequence
  Description of Artificial Sequence: Synthetic oligonucleotide
  Target: ATXN1; (-) strand; PAM type: NNNNGHTT; PAM sequence: GGGGGATT
catctgacattaaaacaact

SEQ ID NO: 26223 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
cctcacaggaaaatcaaatg

SEQ ID NO: 26224 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
gaaggtgaagcattttcaga

SEQ ID NO: 26225 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
tttcaccagataatcacaca

SEQ ID NO: 26226 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
ccatcgtcacgggtttctgc

SEQ ID NO: 26227 - DNA, 20 bp, Artificial Sequence
  Description of Artificial Sequence: Synthetic oligonucleotide
  Target: ATXN1; (-) strand; PAM type: NNNNGHTT; PAM sequence: ACGGGTTT
caagaatggtctccatcgtc

SEQ ID NO: 26228 - DNA, 20 bp, Artificial Sequence
  Description of Artificial Sequence: Synthetic oligonucleotide
  Target: ATXN1; (-) strand; PAM type: NNNNGHTT; PAM sequence: CCCTGTTT
gtcagatcaagagctacttg

SEQ ID NO: 26229 - DNA, 20 bp, Artificial Sequence
  Description of Artificial Sequence: Synthetic oligonucleotide
  Target: ATXN1; (-) strand; PAM type: NNNNGHTT; PAM sequence: TCCAGATT
ttaagcttcttgtgttaagc

SEQ ID NO: 26230 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
acttaaaggagcttcttgtt

SEQ ID NO: 26231 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
ctccaacacttaaaggagct

SEQ ID NO: 26232 - DNA, 20 bp, Artificial Sequence
  Description of Artificial Sequence: Synthetic oligonucleotide
  Target: ATXN1; (-) strand; PAM type: NNNNGHTT; PAM sequence: AGGAGCTT
tctgaagctccaacacttaa

SEQ ID NO: 26233 - DNA, 20 bp, Artificial Sequence
  Description of Artificial Sequence: Synthetic oligonucleotide
  Target: ATXN1; (-) strand; PAM type: NNNNGHTT; PAM sequence: AGCAGCTT
atttaaatagaaatggcagt

SEQ ID NO: 26234 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
ggtttgcgacatgagtgggt

SEQ ID NO: 26235 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
atatgtagtaggcactccat

SEQ ID NO: 26236 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
gcaaagccctagcagactga

SEQ ID NO: 26237 - DNA, 20 bp, Artificial Sequence
  Description of Artificial Sequence: Synthetic oligonucleotide
  Target: ATXN1; (-) strand; PAM type: NNNNGHTT; PAM sequence: GAGTGCTT
tggtatcatggcaactagaa

SEQ ID NO: 26238 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
ttataaaggaacagcataca

SEQ ID NO: 26239 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
cagggtagggatggcaatgg

SEQ ID NO: 26240 - DNA, 20 bp, Artificial Sequence
  Description of Artificial Sequence: Synthetic oligonucleotide
  Target: ATXN1; (-) strand; PAM type: NNNNGHTT; PAM sequence: CCAAGTTT
aagttgatagatgctgtttt

SEQ ID NO: 26241 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
tagatctagaagttgataga

SEQ ID NO: 26242 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
aaacatagttcttgctctca

SEQ ID NO: 26243 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
aaccttgaatcaatgatcaa

SEQ ID NO: 26244 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
tcaacttttcttatttatgc

SEQ ID NO: 26245 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
aaactttgccttgttctttg

SEQ ID NO: 26246 - DNA, 20 bp, Artificial Sequence
  Description of Artificial Sequence: Synthetic oligonucleotide
  Target: ATXN1; (-) strand; PAM type: NNNNGHTT; PAM sequence: CTATGCTT
aatcccagagggaactcatt

SEQ ID NO: 26247 - DNA, 20 bp, Artificial Sequence
  Description of Artificial Sequence: Synthetic oligonucleotide
  Target: ATXN1; (-) strand; PAM type: NNNNGHTT; PAM sequence: ACTAGTTT
ggagaatacactaaaaatca

SEQ ID NO: 26248 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
attccagcaaacaaatccgt

SEQ ID NO: 26249 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
cctttactggggatgaaacg

SEQ ID NO: 26250 - DNA, 20 bp, Artificial Sequence
  Description of Artificial Sequence: Synthetic oligonucleotide
  Target: ATXN1; (-) strand; PAM type: NNNNGHTT; PAM sequence: GACTGATT
tggccccatctcagcagact

SEQ ID NO: 26251 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
tattttagagtcacttaacg

SEQ ID NO: 26252 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
actgactcagcaattttagg

SEQ ID NO: 26253 - DNA, 20 bp, Artificial Sequence
  Description of Artificial Sequence: Synthetic oligonucleotide
  Target: ATXN1; (-) strand; PAM type: NNNNGHTT; PAM sequence: CATGGATT
catttctagagccagcggaa

SEQ ID NO: 26254 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
tttactggctgcctaagtgc

SEQ ID NO: 26255 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
ctctgaatcagagttctgac

SEQ ID NO: 26256 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
acttagtcaaattcaggcaa

SEQ ID NO: 26257 - DNA, 20 bp, Artificial Sequence
  Description of Artificial Sequence: Synthetic oligonucleotide
  Target: ATXN1; (-) strand; PAM type: NNNNGHTT; PAM sequence: CGGAGCTT
gaatggtgtgaacgtggagg

SEQ ID NO: 26258 - DNA, 20 bp, Artificial Sequence
  Description of Artificial Sequence: Synthetic oligonucleotide
  Target: ATXN1; (-) strand; PAM type: NNNNGHTT; PAM sequence: TATGGCTT
atcacatccaggcttatttc

SEQ ID NO: 26259 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
attcatgaatagcatcacat

SEQ ID NO: 26260 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ccctgaacagtttaataaaa

SEQ ID NO: 26261 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
tctgaacgagtggatccctg

SEQ ID NO: 26262 - DNA, 20 bp, Artificial Sequence
  Description of Artificial Sequence: Synthetic oligonucleotide
  Target: ATXN1; (-) strand; PAM type: NNNNGHTT; PAM sequence: TCTAGCTT
ttgtctctcctgggtatacc

SEQ ID NO: 26263 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
aaagaaaaagaaaacaacag

SEQ ID NO: 26264 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
aaaaaaaagaaaaccggtaa

SEQ ID NO: 26265 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
gaaaagtaaaataatgtttc

SEQ ID NO: 26266 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
caaacagatgaaaagtaaaa

SEQ ID NO: 26267 - DNA, 20 bp, Artificial Sequence
  Description of Artificial Sequence: Synthetic oligonucleotide
  Target: ATXN1; (-) strand; PAM type: NNNNGHTT; PAM sequence: CTATGCTT
atgcaccctttgactgtagt

SEQ ID NO: 26268 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
ctccctaaacactgcttgta

SEQ ID NO: 26269 - DNA, 20 bp, Artificial Sequence
  Description of Artificial Sequence: Synthetic oligonucleotide
  Target: ATXN1; (-) strand; PAM type: NNNNGHTT; PAM sequence: CACTGCTT
ttcccattgtcctccctaaa

SEQ ID NO: 26270 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
ttacaggttgtttgggtcca

SEQ ID NO: 26271 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
ttaaaaatgaggtcattaca

SEQ ID NO: 26272 - DNA, 20 bp, Artificial Sequence
  Description of Artificial Sequence: Synthetic oligonucleotide
  Target: ATXN1; (-) strand; PAM type: NNNNGHTT; PAM sequence: GGAAGTTT
ataaatgtggaagagcagca

SEQ ID NO: 26273 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
acaggcaggcatgtaagtgg

SEQ ID NO: 26274 - DNA, 20 bp, Artificial Sequence
  Description of Artificial Sequence: Synthetic oligonucleotide
  Target: ATXN1; (-) strand; PAM type: NNNNGHTT; PAM sequence: TGGGGATT
aaattttacaatagtagata

SEQ ID NO: 26275 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
aaagattgctgttgggcaga

SEQ ID NO: 26276 - DNA, 20 bp, Artificial Sequence
  Description of Artificial Sequence: Synthetic oligonucleotide
  Target: ATXN1; (-) strand; PAM type: NNNNGHTT; PAM sequence: TAAAGATT
aacatccaagattgtttctt

SEQ ID NO: 26277 - DNA, 20 bp, Artificial Sequence
  Description of Artificial Sequence: Synthetic oligonucleotide
  Target: ATXN1; (-) strand; PAM type: NNNNGHTT; PAM sequence: GATTGTTT
aagaaaaggtaaacatccaa

SEQ ID NO: 26278 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
aggtaagaaaaggtaaacat

SEQ ID NO: 26279 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
attagaactgttattattgt

SEQ ID NO: 26280 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
tattctaaattcattcctgc

SEQ ID NO: 26281 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
ttgttatattctaaattcat

SEQ ID NO: 26282 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
catatatagtttaagtgtct

SEQ ID NO: 26283 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
cctattttatttcatgcata

SEQ ID NO: 26284 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcggcctcccaaagtg

SEQ ID NO: 26285 - DNA, 20 bp, Artificial Sequence
  Description of Artificial Sequence: Synthetic oligonucleotide
  Target: ATXN1; (-) strand; PAM type: NNNNGHTT; PAM sequence: AGGGGTTT
ttttgtatttttaatagaga

SEQ ID NO: 26286 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgtctcagcctcccgagtag

SEQ ID NO: 26287 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctccacctcccgggttc

SEQ ID NO: 26288 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
tgggttgattagaggtttgg

SEQ ID NO: 26289 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
atgtaacatgtgggttgatt

SEQ ID NO: 26290 - DNA, 20 bp, Artificial Sequence
  Description of Artificial Sequence: Synthetic oligonucleotide
  Target: ATXN1; (-) strand; PAM type: NNNNGHTT; PAM sequence: GGTTGATT
ttgtgaacatgtaacatgtg

SEQ ID NO: 26291 - DNA, 20 bp, Artificial Sequence
  Description of Artificial Sequence: Synthetic oligonucleotide
  Target: ATXN1; (-) strand; PAM type: NNNNGHTT; PAM sequence: ATGAGATT
ctccagtttgggctctatgc

SEQ ID NO: 26292 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
gtcactaaaagctacagatc

SEQ ID NO: 26293 - DNA, 20 bp, Artificial Sequence
  Description of Artificial Sequence: Synthetic oligonucleotide
  Target: ATXN1; (-) strand; PAM type: NNNNGHTT; PAM sequence: GTGTGCTT
attaatagcaactggcaaat

SEQ ID NO: 26294 - DNA, 20 bp, Artificial Sequence
  Description of Artificial Sequence: Synthetic oligonucleotide
  Target: ATXN1; (-) strand; PAM type: NNNNGHTT; PAM sequence: CAATGATT
cccccacactatcaatatgt

SEQ ID NO: 26295 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
ggcataggtcagaatcttta

SEQ ID NO: 26296 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
gctctcccctttatctagac

SEQ ID NO: 26297 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
gagctcaaaaagccgtgatc

SEQ ID NO: 26298 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
ggggtaagcaacaattatcc

SEQ ID NO: 26299 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
caatgtgtctacctcaaaac

SEQ ID NO: 26300 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ccagaggaaccataccacat

SEQ ID NO: 26301 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
tatgtattttttagtagaga

SEQ ID NO: 26302 - DNA, 20 bp, Artificial Sequence
  Description of Artificial Sequence: Synthetic oligonucleotide
  Target: ATXN1; (-) strand; PAM type: NNNNGHTT; PAM sequence: GCATGATT
tcccaggctggagtgcagtg

SEQ ID NO: 26303 - DNA, 20 bp, Artificial Sequence
  Description of Artificial Sequence: Synthetic oligonucleotide
  Target: ATXN1; (-) strand; PAM type: NNNNGHTT; PAM sequence: GACAGATT
ttctttctttttttttttga

SEQ ID NO: 26304 - DNA, 20 bp, Artificial Sequence
  Description of Artificial Sequence: Synthetic oligonucleotide
  Target: ATXN1; (-) strand; PAM type: NNNNGHTT; PAM sequence: GGGTGATT
tttgagaggtaagcagtcca

SEQ ID NO: 26305 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
ttatttttctctcacataaa

SEQ ID NO: 26306 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
ctaaggtctatttgtaacag

SEQ ID NO: 26307 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
atcaaagttgatctttaatc

SEQ ID NO: 26308 - DNA, 20 bp, Artificial Sequence
  Description of Artificial Sequence: Synthetic oligonucleotide
  Target: ATXN1; (-) strand; PAM type: NNNNGHTT; PAM sequence: TCCCGATT
attaatttgccaactctgct

SEQ ID NO: 26309 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
aagtgtaattaatttgccaa

SEQ ID NO: 26310 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
catcatctatctttagaaaa

SEQ ID NO: 26311 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
attccttgaatatgtgtgac

SEQ ID NO: 26312 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
catcacattttttattattt

SEQ ID NO: 26313 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
tgtagatttatgtactaaga

SEQ ID NO: 26314 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
agtgaaaattaatatagttt

SEQ ID NO: 26315 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
aaaataccagtgaaaattaa

SEQ ID NO: 26316 - DNA, 20 bp, Artificial Sequence
  Description of Artificial Sequence: Synthetic oligonucleotide
  Target: ATXN1; (-) strand; PAM type: NNNNGHTT; PAM sequence: CATAGATT
gatatattttacagctacag

SEQ ID NO: 26317 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
caatatccattagtttcaga

SEQ ID NO: 26318 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
ttgtcagtttagcaatatcc

SEQ ID NO: 26319 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
gaatttaataagtgagtttt

SEQ ID NO: 26320 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
ccattaattgaatttaataa

SEQ ID NO: 26321 - DNA, 20 bp, Artificial Sequence
  Description of Artificial Sequence: Synthetic oligonucleotide
  Target: ATXN1; (-) strand; PAM type: NNNNGHTT; PAM sequence: TGAAGATT
tagtgcatgatttgtgggag

SEQ ID NO: 26322 - DNA, 20 bp, Artificial Sequence
  Description of Artificial Sequence: Synthetic oligonucleotide
  Target: ATXN1; (-) strand; PAM type: NNNNGHTT; PAM sequence: GCATGATT
ttctatttttaatggctagt

SEQ ID NO: 26323 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
gttactttaacatagaggaa

SEQ ID NO: 26324 - DNA, 20 bp, Artificial Sequence
  Description of Artificial Sequence: Synthetic oligonucleotide
  Target: ATXN1; (-) strand; PAM type: NNNNGHTT; PAM sequence: AGATGATT
ggagttttagaagacaaggt

SEQ ID NO: 26325 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tatttagaaagcaacaagag

SEQ ID NO: 26326 - DNA, 20 bp, Artificial Sequence
  Description of Artificial Sequence: Synthetic oligonucleotide
  Target: ATXN1; (-) strand; PAM type: NNNNGHTT; PAM sequence: TCGGGTTT
ggaagaacctctgttggata

SEQ ID NO: 26327 - DNA, 20 bp, Artificial Sequence
  Description of Artificial Sequence: Synthetic oligonucleotide
  Target: ATXN1; (-) strand; PAM type: NNNNGHTT; PAM sequence: TCAGGTTT
ggaagaacctctgttggaga

SEQ ID NO: 26328 - DNA, 20 bp, Artificial Sequence
  Description of Artificial Sequence: Synthetic oligonucleotide
  Target: ATXN1; (-) strand; PAM type: NNNNGHTT; PAM sequence: TCTAGCTT
aaaggatgcccattgtcctt

SEQ ID NO: 26329 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
atttattgcagagttcagga

SEQ ID NO: 26330 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
gcacatctttaaatgcctgt

SEQ ID NO: 26331 - DNA, 20 bp, Artificial Sequence
  Description of Artificial Sequence: Synthetic oligonucleotide
  Target: ATXN1; (-) strand; PAM type: NNNNGHTT; PAM sequence: AGATGCTT
tagatgttggatattatcag

SEQ ID NO: 26332 - DNA, 20 bp, Artificial Sequence
  Description of Artificial Sequence: Synthetic oligonucleotide
  Target: ATXN1; (-) strand; PAM type: NNNNGHTT; PAM sequence: GAGAGTTT
ggtggaatgaaataaagaag

SEQ ID NO: 26333 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
tagttcatgtcaggtgattt

SEQ ID NO: 26334 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
atagcttcatagttcatgtc

SEQ ID NO: 26335 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
cgatattgcttttcataact

SEQ ID NO: 26336 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
agttagaaggtaaatatcga

SEQ ID NO: 26337 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
caccaggcacgtccaggttg

SEQ ID NO: 26338 - DNA, 20 bp, Artificial Sequence
  Description of Artificial Sequence: Synthetic oligonucleotide
  Target: ATXN1; (-) strand; PAM type: NNNNGHTT; PAM sequence: AGGGGCTT
tcagatcataatgtgtgtga

SEQ ID NO: 26339 - DNA, 20 bp, Artificial Sequence
  Description of Artificial Sequence: Synthetic oligonucleotide
  Target: ATXN1; (-) strand; PAM type: NNNNGHTT; PAM sequence: GCAGGATT
attcatgatatccacctcat

SEQ ID NO: 26340 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
acttaactttctacatcagt

SEQ ID NO: 26341 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
taaatctgtagcttttagat

SEQ ID NO: 26342 - DNA, 20 bp, Artificial Sequence
  Description of Artificial Sequence: Synthetic oligonucleotide
  Target: ATXN1; (-) strand; PAM type: NNNNGHTT; PAM sequence: TGTAGCTT
cttcagttctttgataaatc

SEQ ID NO: 26343 - DNA, 20 bp, Artificial Sequence
  Description of Artificial Sequence: Synthetic oligonucleotide
  Target: ATXN1; (-) strand; PAM type: NNNNGHTT; PAM sequence: AGTAGCTT
acgacactgcaaacaatttt

SEQ ID NO: 26344 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
cttttcttaaaatcgtgttt

SEQ ID NO: 26345 - DNA, 20 bp, Artificial Sequence
  Description of Artificial Sequence: Synthetic oligonucleotide
  Target: ATXN1; (-) strand; PAM type: NNNNGHTT; PAM sequence: TCGTGTTT
agttgcctcttttcttaaaa

SEQ ID NO: 26346 - DNA, 20 bp, Artificial Sequence
  Description of Artificial Sequence: Synthetic oligonucleotide
  Target: ATXN1; (-) strand; PAM type: NNNNGHTT; PAM sequence: ACAAGTTT
gttttgaagataacctaaac

SEQ ID NO: 26347 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
gtgcattgtacattagaaat

SEQ ID NO: 26348 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
ttttatattttttaagtttt

SEQ ID NO: 26349 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
taggagcagttttatatttt

SEQ ID NO: 26350 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
atcatgttggagatattagg

SEQ ID NO: 26351 - DNA, 20 bp, Artificial Sequence
  Description of Artificial Sequence: Synthetic oligonucleotide
  Target: ATXN1; (-) strand; PAM type: NNNNGHTT; PAM sequence: GTGAGCTT
gtaaacatgcatagatatat

SEQ ID NO: 26352 - DNA, 20 bp, Artificial Sequence
  Description of Artificial Sequence: Synthetic oligonucleotide
  Target: ATXN1; (-) strand; PAM type: NNNNGHTT; PAM sequence: AACTGATT
aatacaatgttaagtgaaag

SEQ ID NO: 26353 - DNA, 20 bp, Artificial Sequence
  Description of Artificial Sequence: Synthetic oligonucleotide
  Target: ATXN1; (-) strand; PAM type: NNNNGHTT; PAM sequence: ACTAGTTT
cctttaactagctttaaaaa

SEQ ID NO: 26354 - DNA, 20 bp, Artificial Sequence
  Description of Artificial Sequence: Synthetic oligonucleotide
  Target: ATXN1; (-) strand; PAM type: NNNNGHTT; PAM sequence: ACTAGCTT
tttacttcattcttccttta

SEQ ID NO: 26355 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
aaactgtagtttaaggtttt

SEQ ID NO: 26356 - DNA, 20 bp, Artificial Sequence
  Description of Artificial Sequence: Synthetic oligonucleotide
  Target: ATXN1; (-) strand; PAM type: NNNNGHTT; PAM sequence: TAAGGTTT
gttagttacaaactgtagtt

SEQ ID NO: 26357 - DNA, 20 bp, Artificial Sequence
  Description of Artificial Sequence: Synthetic oligonucleotide
  Target: ATXN1; (-) strand; PAM type: NNNNGHTT; PAM sequence: TGTAGTTT
ttttacagttagttacaaac

SEQ ID NO: 26358 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
cttaccatttgccaagtgct

SEQ ID NO: 26359 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
caaattccttaccatttgcc

SEQ ID NO: 26360 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
agactcaattaatatttgct

SEQ ID NO: 26361 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
gacgatggtatgcatcattc

SEQ ID NO: 26362 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
acatgcttggagaaagtcca

SEQ ID NO: 26363 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
caataaatcctcactcattc

SEQ ID NO: 26364 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
taataaaacctgtaaagatc

SEQ ID NO: 26365 - DNA, 20 bp, Artificial Sequence
  Description of Artificial Sequence: Synthetic oligonucleotide
  Target: ATXN1; (-) strand; PAM type: NNNNGHTT; PAM sequence: AGCAGATT
attggtttcttttttttaag

SEQ ID NO: 26366 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
tgtatcaattcaggtcaaat

SEQ ID NO: 26367 - DNA, 20 bp, Artificial Sequence
  Description of Artificial Sequence: Synthetic oligonucleotide
  Target: ATXN1; (-) strand; PAM type: NNNNGHTT; PAM sequence: CTATGATT
cagtttgagactgcagtgag

SEQ ID NO: 26368 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
atgggaggatcacttgagcc

SEQ ID NO: 26369 - DNA, 20 bp, Artificial Sequence
  Description of Artificial Sequence: Synthetic oligonucleotide
  Target: ATXN1; (-) strand; PAM type: NNNNGHTT; PAM sequence: CCAGGATT
ggcaggaggatcacttgagc

SEQ ID NO: 26370 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
cctgtgacctctgtagacat

SEQ ID NO: 26371 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
tttattgactctggcttgcc

SEQ ID NO: 26372 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
catgtaactgatttattgac

SEQ ID NO: 26373 - DNA, 20 bp, Artificial Sequence
  Description of Artificial Sequence: Synthetic oligonucleotide
  Target: ATXN1; (-) strand; PAM type: NNNNGHTT; PAM sequence: AACTGATT
caacaatatcacatacatgt

SEQ ID NO: 26374 - DNA, 20 bp, Artificial Sequence
  Description of Artificial Sequence: Synthetic oligonucleotide
  Target: ATXN1; (-) strand; PAM type: NNNNGHTT; PAM sequence: TGTTGATT
atttgcaaagtgccttaatt

SEQ ID NO: 26375 - DNA, 20 bp, Artificial Sequence
  Description of Artificial Sequence: Synthetic oligonucleotide
  Target: ATXN1; (-) strand; PAM type: NNNNGHTT; PAM sequence: ATTGGATT
gttttataaaagaaaaatag

SEQ ID NO: 26376 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
ttcctgttttataaaagaaa

SEQ ID NO: 26377 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
cctgtgtttctaatattcct

SEQ ID NO: 26378 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
ttactgagatgttcaacttc

SEQ ID NO: 26379 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
ctcttgtttctgtccatatc

SEQ ID NO: 26380 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
cttttccattctctccttcc

SEQ ID NO: 26381 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
tagagggctttcactcggtt

SEQ ID NO: 26382 - DNA, 20 bp, Artificial Sequence
  Description of Artificial Sequence: Synthetic oligonucleotide
  Target: ATXN1; (-) strand; PAM type: NNNNGHTT; PAM sequence: CTCGGTTT
tcagtgttagagggctttca

SEQ ID NO: 26383 - DNA, 20 bp, Artificial Sequence
  Description of Artificial Sequence: Synthetic oligonucleotide
  Target: ATXN1; (-) strand; PAM type: NNNNGHTT; PAM sequence: GAGGGCTT
cttattgcatttcagtgtta

SEQ ID NO: 26384 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
ccactgtgcccagcccacag

SEQ ID NO: 26385 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
tgcctcagactcccaaagag

SEQ ID NO: 26386 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
ccttctgcctcagactccca

SEQ ID NO: 26387 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gtttgtttgtttgtttgttt

SEQ ID NO: 26388 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gtttgtttgtttgtttgttt

SEQ ID NO: 26389 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
atttgtttgtttgtttgttt

SEQ ID NO: 26390 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
atttatttgtttgtttgttt

SEQ ID NO: 26391 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gttcatttatttgtttgttt

SEQ ID NO: 26392 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
acaggttcatttatttgttt

SEQ ID NO: 26393 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
taccacaggttcatttattt

SEQ ID NO: 26394 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
actctaccacaggttcattt

SEQ ID NO: 26395 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
atcaatgtaagaatacaact

SEQ ID NO: 26396 - DNA, 20 bp, Artificial Sequence
  Description of Artificial Sequence: Synthetic oligonucleotide
  Target: ATXN1; (-) strand; PAM type: NNNNGHTT; PAM sequence: GGACGTTT
tcatttctaaatggtggcca

SEQ ID NO: 26397 - DNA, 20 bp, Artificial Sequence
  Description of Artificial Sequence: Synthetic oligonucleotide
  Target: ATXN1; (-) strand; PAM type: NNNNGHTT; PAM sequence: GATTGCTT
ttcacttggtaactgctaat

SEQ ID NO: 26398 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
gtctttcacttggtaactgc

SEQ ID NO: 26399 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
acacgtgtgtgggacagatc

SEQ ID NO: 26400 - DNA, 20 bp, Artificial Sequence
  Description of Artificial Sequence: Synthetic oligonucleotide
  Target: ATXN1; (-) strand; PAM type: NNNNGHTT; PAM sequence: TATGGCTT
catgccctaacctgatcaga

SEQ ID NO: 26401 - DNA, 20 bp, Artificial Sequence
  Description of Artificial Sequence: Synthetic oligonucleotide
  Target: ATXN1; (-) strand; PAM type: NNNNGHTT; PAM sequence: CTACGATT
atatgtgggaattgtgggag

SEQ ID NO: 26402 - DNA, 20 bp, Artificial Sequence
  Description of Artificial Sequence: Synthetic oligonucleotide
  Target: ATXN1; (-) strand; PAM type: NNNNGHTT; PAM sequence: GGAGGCTT
tcacagttccacgtggctgg

SEQ ID NO: 26403 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
taggtaatttataaagaaaa

SEQ ID NO: 26404 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
gggtgtgatgccctgtatta

SEQ ID NO: 26405 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
ttatcacctggtttatgccg

SEQ ID NO: 26406 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
gtcattacaatgtattatca

SEQ ID NO: 26407 - DNA, 20 bp, Artificial Sequence
  Description of Artificial Sequence: Synthetic oligonucleotide
  Target: ATXN1; (-) strand; PAM type: NNNNGHTT; PAM sequence: GAGTGATT
cagatgctaaggattttatt

SEQ ID NO: 26408 - DNA, 20 bp, Artificial Sequence
  Description of Artificial Sequence: Synthetic oligonucleotide
  Target: ATXN1; (-) strand; PAM type: NNNNGHTT; PAM sequence: TAAGGATT
tcgaggtatatagcagatgc

SEQ ID NO: 26409 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
tttttttttgctcatatcct

SEQ ID NO: 26410 - DNA, 20 bp, Artificial Sequence
  Description of Artificial Sequence: Synthetic oligonucleotide
  Target: ATXN1; (-) strand; PAM type: NNNNGHTT; PAM sequence: GCTGGATT
tgtgggctttatttcttcaa

SEQ ID NO: 26411 - DNA, 20 bp, Artificial Sequence
  Description of Artificial Sequence: Synthetic oligonucleotide
  Target: ATXN1; (-) strand; PAM type: NNNNGHTT; PAM sequence: GTGGGCTT
gttccctaatttttttatgt

SEQ ID NO: 26412 - DNA, 20 bp, Artificial Sequence
  Description of Artificial Sequence: Synthetic oligonucleotide
  Target: ATXN1; (-) strand; PAM type: NNNNGHTT; PAM sequence: TCTAGCTT
ctgttatttctaataaaccc

SEQ ID NO: 26413 - DNA, 20 bp, Artificial Sequence
  Description of Artificial Sequence: Synthetic oligonucleotide
  Target: ATXN1; (-) strand; PAM type: NNNNGHTT; PAM sequence: GGAAGTTT
aactatggtttttatagtag

SEQ ID NO: 26414 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
atgttaaagcaggcttaaac

SEQ ID NO: 26415 - DNA, 20 bp, Artificial Sequence
  Description of Artificial Sequence: Synthetic oligonucleotide
  Target: ATXN1; (-) strand; PAM type: NNNNGHTT; PAM sequence: GCAGGCTT
aaaccagatctaatgttaaa

SEQ ID NO: 26416 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
catttataggttgttaaatt

SEQ ID NO: 26417 - DNA, 20 bp, Artificial Sequence
  Description of Artificial Sequence: Synthetic oligonucleotide
  Target: ATXN1; (-) strand; PAM type: NNNNGHTT; PAM sequence: CTAAGATT
taattgatgctcacttagac

SEQ ID NO: 26418 - DNA, 20 bp, Artificial Sequence
  Description of Artificial Sequence: Synthetic oligonucleotide
  Target: ATXN1; (-) strand; PAM type: NNNNGHTT; PAM sequence: CCCAGCTT
tttcttctttcatcccaggc

SEQ ID NO: 26419 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
ttcccctaatatttatgtgc

SEQ ID NO: 26420 - DNA, 20 bp, Artificial Sequence
  Description of Artificial Sequence: Synthetic oligonucleotide
  Target: ATXN1; (-) strand; PAM type: NNNNGHTT; PAM sequence: CTCGGCTT
gctgggagagggcagaatgc

SEQ ID NO: 26421 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
aggtgccttcctgatcatgc

SEQ ID NO: 26422 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
agtcatggaaatcagtgaag

SEQ ID NO: 26423 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
aaaaaaggagttttctgtca

SEQ ID NO: 26424 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
taaagtttaaattgaaaaaa

SEQ ID NO: 26425 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
agtaacagagctgtagttct

SEQ ID NO: 26426 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
cttgtcctgatgatatttgc

SEQ ID NO: 26427 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
gagacacttgtcctgatgat

SEQ ID NO: 26428 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
ggaattgcagagttgttgac

SEQ ID NO: 26429 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
tctaggtcccccagaaacta

SEQ ID NO: 26430 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
gtgggcacacagagctaaat

SEQ ID NO: 26431 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
ggagtatattttccaaagca

SEQ ID NO: 26432 - DNA, 20 bp, Artificial Sequence
  Description of Artificial Sequence: Synthetic oligonucleotide
  Target: ATXN1; (-) strand; PAM type: NNNNGHTT; PAM sequence: CAGGGCTT
tgccatggggcaccagtgcc

SEQ ID NO: 26433 - DNA, 20 bp, Artificial Sequence
  Description of Artificial Sequence: Synthetic oligonucleotide
  Target: ATXN1; (-) strand; PAM type: NNNNGHTT; PAM sequence: GTAGGCTT
catttacatttttccctttt

SEQ ID NO: 26434 - DNA, 20 bp, Artificial Sequence
  Description of Artificial Sequence: Synthetic oligonucleotide
  Target: ATXN1; (-) strand; PAM type: NNNNGHTT; PAM sequence: TAAAGATT
cttcctaagtcttaagatat

SEQ ID NO: 26435 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
catttctgtaacattactga

SEQ ID NO: 26436 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ggatttagtccaaagtgcct

SEQ ID NO: 26437 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
gatatgctgtgggtacaaag

SEQ ID NO: 26438 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
ccccacacaccccaagtgag

SEQ ID NO: 26439 - DNA, 20 bp, Artificial Sequence
  Description of Artificial Sequence: Synthetic oligonucleotide
  Target: ATXN1; (-) strand; PAM type: NNNNGHTT; PAM sequence: CCTAGATT
acagattgataacaactcca

SEQ ID NO: 26440 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
ttcaaatttgtgaaagacta

SEQ ID NO: 26441 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
gcaatgctttgagggtgatt

SEQ ID NO: 26442 - DNA, 20 bp, Artificial Sequence
  Description of Artificial Sequence: Synthetic oligonucleotide
  Target: ATXN1; (-) strand; PAM type: NNNNGHTT; PAM sequence: GGGTGATT
atatcattgcaatgctttga

SEQ ID NO: 26443 - DNA, 20 bp, Artificial Sequence
  Description of Artificial Sequence: Synthetic oligonucleotide
  Target: ATXN1; (-) strand; PAM type: NNNNGHTT; PAM sequence: CAATGCTT
ctgtttccttcatatcattg

SEQ ID NO: 26444 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
acctccacaggccccatgtc

SEQ ID NO: 26445 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
gggaaattgtcttgaaaagc

SEQ ID NO: 26446 - DNA, 20 bp, Artificial Sequence
  Description of Artificial Sequence: Synthetic oligonucleotide
  Target: ATXN1; (-) strand; PAM type: NNNNGHTT; PAM sequence: TCTCGATT
taagacatttatttttgtat

SEQ ID NO: 26447 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
agaaaaaaataatgtaaatg

SEQ ID NO: 26448 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
aggtttaaaagaagtgattt

SEQ ID NO: 26449 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
atcaacattaggtttaaaag

SEQ ID NO: 26450 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
agtagaatttggtatcaaca

SEQ ID NO: 26451 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
ttaaattgaacaattctaaa

SEQ ID NO: 26452 - DNA, 20 bp, Artificial Sequence
  Description of Artificial Sequence: Synthetic oligonucleotide
  Target: ATXN1; (-) strand; PAM type: NNNNGHTT; PAM sequence: CAAGGCTT
tatatataactacagtatga

SEQ ID NO: 26453 - DNA, 20 bp, Artificial Sequence
  Description of Artificial Sequence: Synthetic oligonucleotide
  Target: ATXN1; (-) strand; PAM type: NNNNGHTT; PAM sequence: GCTAGATT
atgaatgaaaccattttgaa

SEQ ID NO: 26454 - DNA, 20 bp, Artificial Sequence
  Description of Artificial Sequence: Synthetic oligonucleotide
  Target: ATXN1; (-) strand; PAM type: NNNNGHTT; PAM sequence: GTTTGATT
cagcttcaggatttggtgag

SEQ ID NO: 26455 - DNA, 20 bp, Artificial Sequence
  Description of Artificial Sequence: Synthetic oligonucleotide
  Target: ATXN1; (-) strand; PAM type: NNNNGHTT; PAM sequence: TGAGGTTT
ccagcagcttcaggatttgg

SEQ ID NO: 26456 - DNA, 20 bp, Artificial Sequence
  Description of Artificial Sequence: Synthetic oligonucleotide
  Target: ATXN1; (-) strand; PAM type: NNNNGHTT; PAM sequence: TCAGGATT
agatcaaggtgccagcagct

SEQ ID NO: 26457 - DNA, 20 bp, Artificial Sequence
  Description of Artificial Sequence: Synthetic oligonucleotide
  Target: ATXN1; (-) strand; PAM type: NNNNGHTT; PAM sequence: AGCAGCTT
aagtccaagatcaaggtgcc

SEQ ID NO: 26458 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
tcctttgaggtggatgtatt

SEQ ID NO: 26459 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
tgccacattcactccagttg

SEQ ID NO: 26460 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
cactaatcccagtgagctgt

SEQ ID NO: 26461 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
gctttgctcatctttcagga

SEQ ID NO: 26462 - DNA, 20 bp, Artificial Sequence
  Description of Artificial Sequence: Synthetic oligonucleotide
  Target: ATXN1; (-) strand; PAM type: NNNNGHTT; PAM sequence: TCAGGATT
gtaactgctttgctcatctt

SEQ ID NO: 26463 - DNA, 20 bp, Artificial Sequence
  Description of Artificial Sequence: Synthetic oligonucleotide
  Target: ATXN1; (-) strand; PAM type: NNNNGHTT; PAM sequence: AACTGCTT
gctgcccttctgtctttggt

SEQ ID NO: 26464 - DNA, 20 bp, Artificial Sequence
  Description of Artificial Sequence: Synthetic oligonucleotide
  Target: ATXN1; (-) strand; PAM type: NNNNGHTT; PAM sequence: CAGCGTTT
atagttttacaagcattttt

SEQ ID NO: 26465 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
gtgtgcttatgctatgccgc

SEQ ID NO: 26466 - DNA, 20 bp, Artificial Sequence
  Description of Artificial Sequence: Synthetic oligonucleotide
  Target: ATXN1; (-) strand; PAM type: NNNNGHTT; PAM sequence: GTGTGCTT
gccattctcccaaacactgc

SEQ ID NO: 26467 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
tagtttcccaaatggagctc

SEQ ID NO: 26468 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
aggcagaaggcgcttagagc

SEQ ID NO: 26469 - DNA, 20 bp, Artificial Sequence
  Description of Artificial Sequence: Synthetic oligonucleotide
  Target: ATXN1; (-) strand; PAM type: NNNNGHTT; PAM sequence: AGGCGCTT
cttgccatgaagtaggcaga

SEQ ID NO: 26470 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
tgcaagaattagaacttggc

SEQ ID NO: 26471 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
tggtatctaaatctaaggta

SEQ ID NO: 26472 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
agggtataatgtatattata

SEQ ID NO: 26473 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
ttcccttaacctacatgagc

SEQ ID NO: 26474 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
actgttcatagaatctgtag

SEQ ID NO: 26475 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
agagcactgttcatagaatc

SEQ ID NO: 26476 - DNA, 20 bp, Artificial Sequence
  Description of Artificial Sequence: Synthetic oligonucleotide
  Target: ATXN1; (-) strand; PAM type: NNNNGHTT; PAM sequence: CCGTGATT
gcagtcaaggctgcggtgag

SEQ ID NO: 26477 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgggaggactgcttgaaccc

SEQ ID NO: 26478 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
ttgggaagctgaggtgggag

SEQ ID NO: 26479 - DNA, 20 bp, Artificial Sequence
  Description of Artificial Sequence: Synthetic oligonucleotide
  Target: ATXN1; (-) strand; PAM type: NNNNGHTT; PAM sequence: GTGGGCTT
ctctgggtagatacccagta

SEQ ID NO: 26480 - DNA, 20 bp, Artificial Sequence
  Description of Artificial Sequence: Synthetic oligonucleotide
  Target: ATXN1; (-) strand; PAM type: NNNNGHTT; PAM sequence: CCATGATT
gatgggcatttgggttggtt

SEQ ID NO: 26481 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
atcagtgagaacatatgatg

SEQ ID NO: 26482 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
cacatatcagtgagaacata

SEQ ID NO: 26483 - DNA, 20 bp, Artificial Sequence
  Description of Artificial Sequence: Synthetic oligonucleotide
  Target: ATXN1; (-) strand; PAM type: NNNNGHTT; PAM sequence: CATAGCTT
ttcttatgcctttgcatcct

SEQ ID NO: 26484 - DNA, 20 bp, Artificial Sequence
  Description of Artificial Sequence: Synthetic oligonucleotide
  Target: ATXN1; (-) strand; PAM type: NNNNGHTT; PAM sequence: GTGAGATT
aagttctttagtggcgattt

SEQ ID NO: 26485 - DNA, 20 bp, Artificial Sequence
  Description of Artificial Sequence: Synthetic oligonucleotide
  Target: ATXN1; (-) strand; PAM type: NNNNGHTT; PAM sequence: TGGCGATT
tggttacataagttctttag

SEQ ID NO: 26486 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
tgaatgaataagctgttact

SEQ ID NO: 26487 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
ctcaactgaattttactcat

SEQ ID NO: 26488 - DNA, 20 bp, Artificial Sequence
  Description of Artificial Sequence: Synthetic oligonucleotide
  Target: ATXN1; (-) strand; PAM type: NNNNGHTT; PAM sequence: TAGAGCTT
atgttcaaaaatgacccatc

SEQ ID NO: 26489 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
cttactttttaagccactta

SEQ ID NO: 26490 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
ttcctattttgttccttctt

SEQ ID NO: 26491 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
tacagtccatgtggacccac

SEQ ID NO: 26492 - DNA, 20 bp, Artificial Sequence
  Description of Artificial Sequence: Synthetic oligonucleotide
  Target: ATXN1; (-) strand; PAM type: NNNNGHTT; PAM sequence: CCTGGATT
tcacaagccagtgatgtaca

SEQ ID NO: 26493 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
ttctgcgcatctgtgatctg

SEQ ID NO: 26494 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
taagcagagggaatctgatg

SEQ ID NO: 26495 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
gcatgtattcagccccttct

SEQ ID NO: 26496 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
gcatatagtagacactcact

SEQ ID NO: 26497 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
agaatgatatttaagggtta

SEQ ID NO: 26498 - DNA, 20 bp, Artificial Sequence
  Description of Artificial Sequence: Synthetic oligonucleotide
  Target: ATXN1; (-) strand; PAM type: NNNNGHTT; PAM sequence: CCAAGCTT
gaatattagataataaatag

SEQ ID NO: 26499 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
gtctggcattttcaggcaga

SEQ ID NO: 26500 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
tcacccaccctgaatgccac

SEQ ID NO: 26501 - DNA, 20 bp, Artificial Sequence
  Description of Artificial Sequence: Synthetic oligonucleotide
  Target: ATXN1; (-) strand; PAM type: NNNNGHTT; PAM sequence: ACAGGCTT
cagaaaagacaatgagccag

SEQ ID NO: 26502 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
ggagatgagtgtcaagcatt

SEQ ID NO: 26503 - DNA, 20 bp, Artificial Sequence
  Description of Artificial Sequence: Synthetic oligonucleotide
  Target: ATXN1; (-) strand; PAM type: NNNNGHTT; PAM sequence: GGTAGTTT
ccataacaatgcctgccagt

SEQ ID NO: 26504 - DNA, 20 bp, Artificial Sequence
  Description of Artificial Sequence: Synthetic oligonucleotide
  Target: ATXN1; (-) strand; PAM type: NNNNGHTT; PAM sequence: GTCAGATT
ttcacaaggacaccagttct

SEQ ID NO: 26505 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcgacctcccaaagtg

SEQ ID NO: 26506 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
aatttttgtaatagtagaga

SEQ ID NO: 26507 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
aacctctgcctcccaggttc

SEQ ID NO: 26508 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
ggatctgttccaggtcactc

SEQ ID NO: 26509 - DNA, 20 bp, Artificial Sequence
  Description of Artificial Sequence: Synthetic oligonucleotide
  Target: ATXN1; (-) strand; PAM type: NNNNGHTT; PAM sequence: CTTAGATT
gtatagaaacgtcagtggct

SEQ ID NO: 26510 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
gttagtggaacttcaatttg

SEQ ID NO: 26511 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
ctggcccaaatgaattatta

SEQ ID NO: 26512 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tgccttggcctcccaaagtg

SEQ ID NO: 26513 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
tctcctgcctggctattttt

SEQ ID NO: 26514 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
ctcaaacttctgggcccaag

SEQ ID NO: 26515 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
aacaattttggatttaaaaa

SEQ ID NO: 26516 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
ataaactattttaaaacaat

SEQ ID NO: 26517 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
cagtgtggcccagggaagcc

SEQ ID NO: 26518 - DNA, 20 bp, Artificial Sequence
  Description of Artificial Sequence: Synthetic oligonucleotide
  Target: ATXN1; (-) strand; PAM type: NNNNGHTT; PAM sequence: GCAAGTTT
ggaacacttggccaagactt

SEQ ID NO: 26519 - DNA, 20 bp, Artificial Sequence
  Description of Artificial Sequence: Synthetic oligonucleotide
  Target: ATXN1; (-) strand; PAM type: NNNNGHTT; PAM sequence: CAAGGCTT
cttgggacagagaggagtaa

SEQ ID NO: 26520 - DNA, 20 bp, Artificial Sequence
  Description of Artificial Sequence: Synthetic oligonucleotide
  Target: ATXN1; (-) strand; PAM type: NNNNGHTT; PAM sequence: CTTAGATT
cagaaaggtcaatgattaaa

SEQ ID NO: 26521 - DNA, 20 bp, Artificial Sequence
  Description of Artificial Sequence: Synthetic oligonucleotide
  Target: ATXN1; (-) strand; PAM type: NNNNGHTT; PAM sequence: CAATGATT
ccttgtgaggtcagaaaggt

SEQ ID NO: 26522 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
gaggacaagttctgtgctta

SEQ ID NO: 26523 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
ccatctaaggaggacaagtt

SEQ ID NO: 26524 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
ttacgtgaaagactaagttt

SEQ ID NO: 26525 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
ctctcccattacgtgaaaga

SEQ ID NO: 26526 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
ggcaacttatattttaagaa

SEQ ID NO: 26527 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
gtgtagatgttaaatgaata

SEQ ID NO: 26528 - DNA, 20 bp, Artificial Sequence
  Description of Artificial Sequence: Synthetic oligonucleotide
  Target: ATXN1; (-) strand; PAM type: NNNNGHTT; PAM sequence: ACCCGTTT
ggcagaaaagatgctgtctt

SEQ ID NO: 26529 - DNA, 20 bp, Artificial Sequence
  Description of Artificial Sequence: Synthetic oligonucleotide
  Target: ATXN1; (-) strand; PAM type: NNNNGHTT; PAM sequence: TCCTGATT
tcacaggctggcaaggttgc

SEQ ID NO: 26530 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
accccacataaccttggcat

SEQ ID NO: 26531 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
gcaatcaggtgcatgcgttt

SEQ ID NO: 26532 - DNA, 20 bp, Artificial Sequence
  Description of Artificial Sequence: Synthetic oligonucleotide
  Target: ATXN1; (-) strand; PAM type: NNNNGHTT; PAM sequence: ATGCGTTT
tatatgttgcaatcaggtgc

SEQ ID NO: 26533 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
atgaagctctctgataggaa

SEQ ID NO: 26534 - DNA, 20 bp, Artificial Sequence
  Description of Artificial Sequence: Synthetic oligonucleotide
  Target: ATXN1; (-) strand; PAM type: NNNNGHTT; PAM sequence: TCACGATT
ttccatgttcagttgtttaa

SEQ ID NO: 26535 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
tgtggccttattccatgttc

SEQ ID NO: 26536 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
ggaactgtgtcttttagatc

SEQ ID NO: 26537 - DNA, 20 bp, Artificial Sequence
  Description of Artificial Sequence: Synthetic oligonucleotide
  Target: ATXN1; (-) strand; PAM type: NNNNGHTT; PAM sequence: ATGAGATT
actggggattacaatttgac

SEQ ID NO: 26538 - DNA, 20 bp, Artificial Sequence
  Description of Artificial Sequence: Synthetic oligonucleotide
  Target: ATXN1; (-) strand; PAM type: NNNNGHTT; PAM sequence: TGGGGATT
caggcccttcctccaaacac

SEQ ID NO: 26539 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
agaaaagaggtttaattggc

SEQ ID NO: 26540 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
ctggataatgtgtaaagaaa

SEQ ID NO: 26541 - DNA, 20 bp, Artificial Sequence
  Description of Artificial Sequence: Synthetic oligonucleotide
  Target: ATXN1; (-) strand; PAM type: NNNNGHTT; PAM sequence: GTAAGATT
cccacccatgaaactcatat

SEQ ID NO: 26542 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
cctggtctcactgagccact

SEQ ID NO: 26543 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
cccctcctggcatgccatac

SEQ ID NO: 26544 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
aatgttcctgcctaaccctt

SEQ ID NO: 26545 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
cattgcagcaagttcctccc

SEQ ID NO: 26546 - DNA, 20 bp, Artificial Sequence
  Description of Artificial Sequence: Synthetic oligonucleotide
  Target: ATXN1; (-) strand; PAM type: NNNNGHTT; PAM sequence: CCATGCTT
ccctgtccgcctcctcttct

SEQ ID NO: 26547 - DNA, 20 bp, Artificial Sequence
  Description of Artificial Sequence: Synthetic oligonucleotide
  Target: ATXN1; (-) strand; PAM type: NNNNGHTT; PAM sequence: CCATGATT
tgagttagaaaggagctaga

SEQ ID NO: 26548 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
gagaactttcagcgtcaagt

SEQ ID NO: 26549 - DNA, 20 bp, Artificial Sequence
  Description of Artificial Sequence: Synthetic oligonucleotide
  Target: ATXN1; (-) strand; PAM type: NNNNGHTT; PAM sequence: GGGGGATT
tcgagtacctactgcatgta

SEQ ID NO: 26550 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
agagaaagttatttttgtgt

SEQ ID NO: 26551 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
agatagagaaagttattttt

SEQ ID NO: 26552 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
agattagcacgttatcagaa

SEQ ID NO: 26553 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
tatcaggagagaaaatgtgt

SEQ ID NO: 26554 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
gccctgtatcaggagagaaa

SEQ ID NO: 26555 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
agtaagataggaatgattag

SEQ ID NO: 26556 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
cctaacccagagtaagatag

SEQ ID NO: 26557 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
ctggaatgtgtcatcgtatg

SEQ ID NO: 26558 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
aataatgatcctgtaatgca

SEQ ID NO: 26559 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
ttttgcatagattcctgaat

SEQ ID NO: 26560 - DNA, 20 bp, Artificial Sequence
  Description of Artificial Sequence: Synthetic oligonucleotide
  Target: ATXN1; (-) strand; PAM type: NNNNGHTT; PAM sequence: CATAGATT
ccttcacttaattatttttg

SEQ ID NO: 26561 - DNA, 20 bp, Artificial Sequence
  Description of Artificial Sequence: Synthetic oligonucleotide
  Target: ATXN1; (-) strand; PAM type: NNNNGHTT; PAM sequence: GAGTGATT
aagggcagaatggcaaggag

SEQ ID NO: 26562 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
gttcagtctgatctgaaagc

SEQ ID NO: 26563 - DNA, 20 bp, Artificial Sequence
  Description of Artificial Sequence: Synthetic oligonucleotide
  Target: ATXN1; (-) strand; PAM type: NNNNGHTT; PAM sequence: ATAGGTTT
gttaatgtattggttttatc

SEQ ID NO: 26564 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
atatccacatatgttaatgt

SEQ ID NO: 26565 - DNA, 20 bp, Artificial Sequence
  Description of Artificial Sequence: Synthetic oligonucleotide
  Target: ATXN1; (-) strand; PAM type: NNNNGHTT; PAM sequence: ATGCGTTT
gtacatcttttagtcctaat

SEQ ID NO: 26566 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
ataatcaaaatatttttaaa

SEQ ID NO: 26567 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
caggcagattgcttgagccc

SEQ ID NO: 26568 - DNA, 20 bp, Artificial Sequence
  Description of Artificial Sequence: Synthetic oligonucleotide
  Target: ATXN1; (-) strand; PAM type: NNNNGHTT; PAM sequence: GATTGCTT
ttgggaggctgaggcaggca

SEQ ID NO: 26569 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
cactttgggaggctgaggca

SEQ ID NO: 26570 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
agtcaatctgtcattcagag

SEQ ID NO: 26571 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
ttcctagtcaatctgtcatt

SEQ ID NO: 26572 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
aggggaaaagatcagcttaa

SEQ ID NO: 26573 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
tttaatgaggaggggaaaag

SEQ ID NO: 26574 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
tgcctccacaggggccatat

SEQ ID NO: 26575 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
agttcatgtctctctacatt

SEQ ID NO: 26576 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
gaatcacgagcaagcatagt

SEQ ID NO: 26577 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
ccctgggagggtaacccctg

SEQ ID NO: 26578 - DNA, 20 bp, Artificial Sequence
  Description of Artificial Sequence: Synthetic oligonucleotide
  Target: ATXN1; (-) strand; PAM type: NNNNGHTT; PAM sequence: TAAGGATT
acaatgtttccaagttgttt

SEQ ID NO: 26579 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
tcatcccaacaatgtttcca

SEQ ID NO: 26580 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
tccctacctactcatcccaa

SEQ ID NO: 26581 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
agagtgtttcgttaaagttg

SEQ ID NO: 26582 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
acaatgctatctgttctaga

SEQ ID NO: 26583 - DNA, 20 bp, Artificial Sequence
  Description of Artificial Sequence: Synthetic oligonucleotide
  Target: ATXN1; (-) strand; PAM type: NNNNGHTT; PAM sequence: GCCTGATT
ttgacaggagatatctgata

SEQ ID NO: 26584 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
tacactacctggcatgtagt

SEQ ID NO: 26585 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
taaattcattgttgttgttg

SEQ ID NO: 26586 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
ctggctgaatttatgcaatt

SEQ ID NO: 26587 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
actggtaagttgcttagatt

SEQ ID NO: 26588 - DNA, 20 bp, Artificial Sequence
  Description of Artificial Sequence: Synthetic oligonucleotide
  Target: ATXN1; (-) strand; PAM type: NNNNGHTT; PAM sequence: CTTAGATT
ctccactgactggtaagttg

SEQ ID NO: 26589 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
ggctcctccactgactggta

SEQ ID NO: 26590 - DNA, 20 bp, Artificial Sequence
  Description of Artificial Sequence: Synthetic oligonucleotide
  Target: ATXN1; (-) strand; PAM type: NNNNGHTT; PAM sequence: CCTGGATT
tggacttggggtcggaggaa

SEQ ID NO: 26591 - DNA, 20 bp, Artificial Sequence
  Description of Artificial Sequence: Synthetic oligonucleotide
  Target: ATXN1; (-) strand; PAM type: NNNNGHTT; PAM sequence: TGTCGTTT
gccatcatgaaaaccaagat

SEQ ID NO: 26592 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
gttattggccatcatgaaaa

SEQ ID NO: 26593 - DNA, 20 bp, Artificial Sequence
  Description of Artificial Sequence: Synthetic oligonucleotide
  Target: ATXN1; (-) strand; PAM type: NNNNGHTT; PAM sequence: GTAGGCTT
ttcacactcccctgtgcata

SEQ ID NO: 26594 - DNA, 20 bp, Artificial Sequence
  Description of Artificial Sequence: Synthetic oligonucleotide
  Target: ATXN1; (-) strand; PAM type: NNNNGHTT; PAM sequence: CCCGGCTT
gtcagtggtcaaggctctgc

SEQ ID NO: 26595 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
gcagcccctttcaccgtgac

SEQ ID NO: 26596 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
cagtttttttgaggaatttc

SEQ ID NO: 26597 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
agagaaaccaccacttgatc

SEQ ID NO: 26598 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
tctgaatcttattgaatcat

SEQ ID NO: 26599 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
gactgtaggatgcagagacc

SEQ ID NO: 26600 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
tctttgcagcaagcctatga

SEQ ID NO: 26601 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
atatttcttacagtcatatc

SEQ ID NO: 26602 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgccttggcctcccaaagtg

SEQ ID NO: 26603 - DNA, 20 bp, Artificial Sequence
  Description of Artificial Sequence: Synthetic oligonucleotide
  Target: ATXN1; (-) strand; PAM type: NNNNGHTT; PAM sequence: CGAGGTTT
ttttgtacttttagtacaga

SEQ ID NO: 26604 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctccgcctcccgggttc

SEQ ID NO: 26605 - DNA, 20 bp, Artificial Sequence
  Description of Artificial Sequence: Synthetic oligonucleotide
  Target: ATXN1; (-) strand; PAM type: NNNNGHTT; PAM sequence: TGTCGCTT
tctacagtaaatgcaatatc

SEQ ID NO: 26606 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
gctgcgtagttcttgtagtg

SEQ ID NO: 26607 - DNA, 20 bp, Artificial Sequence
  Description of Artificial Sequence: Synthetic oligonucleotide
  Target: ATXN1; (-) strand; PAM type: NNNNGHTT; PAM sequence: GCTCGCTT
gagcagaaggtgtgtcacat

SEQ ID NO: 26608 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
aacccttttcaattttgctt

SEQ ID NO: 26609 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tttccattaacccttttcaa

SEQ ID NO: 26610 - DNA, 20 bp, Artificial Sequence
  Description of Artificial Sequence: Synthetic oligonucleotide
  Target: ATXN1; (-) strand; PAM type: NNNNGHTT; PAM sequence: TAGTGCTT
ggtacacctgaatgtttagt

SEQ ID NO: 26611 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
atgtgagtcagggtacacct

SEQ ID NO: 26612 - DNA, 20 bp, Artificial Sequence
  Description of Artificial Sequence: Synthetic oligonucleotide
  Target: ATXN1; (-) strand; PAM type: NNNNGHTT; PAM sequence: GAACGATT
ggtcccacttatttgaaata

SEQ ID NO: 26613 - DNA, 20 bp, Artificial Sequence
  Description of Artificial Sequence: Synthetic oligonucleotide
  Target: ATXN1; (-) strand; PAM type: NNNNGHTT; PAM sequence: AGAGGATT
cttggtgcagtgagtcagtg

SEQ ID NO: 26614 - DNA, 20 bp, Artificial Sequence
  Description of Artificial Sequence: Synthetic oligonucleotide
  Target: ATXN1; (-) strand; PAM type: NNNNGHTT; PAM sequence: CATAGCTT
tgggaaatgaatagcaagaa

SEQ ID NO: 26615 - DNA, 20 bp, Artificial Sequence
  Description of Artificial Sequence: Synthetic oligonucleotide
  Target: ATXN1; (-) strand; PAM type: NNNNGHTT; PAM sequence: ACAAGCTT
tactttttatgtcaccttga

SEQ ID NO: 26616 - DNA, 20 bp, Artificial Sequence
  Description of Artificial Sequence: Synthetic oligonucleotide
  Target: ATXN1; (-) strand; PAM type: NNNNGHTT; PAM sequence: TGTAGTTT
cagtagggtggacttgagtc

SEQ ID NO: 26617 - DNA, 20 bp, Artificial Sequence
  Description of Artificial Sequence: Synthetic oligonucleotide
  Target: ATXN1; (-) strand; PAM type: NNNNGHTT; PAM sequence: TAAAGATT
atgcagggcatggagggtaa

SEQ ID NO: 26618 - DNA, 20 bp, Artificial Sequence
  Description of Artificial Sequence: Synthetic oligonucleotide
  Target: ATXN1; (-) strand; PAM type: NNNNGHTT; PAM sequence: AGATGCTT
cagtgcagtgtatgagagaa

SEQ ID NO: 26619 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
atgttgtcttgtttttcgta

SEQ ID NO: 26620 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
gactccttgaatctatgttg

SEQ ID NO: 26621 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
tgtgtgtgtgtgtgtgtgtg

SEQ ID NO: 26622 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
actctctgctgttccatctt

SEQ ID NO: 26623 - DNA, 20 bp, Artificial Sequence
  Description of Artificial Sequence: Synthetic oligonucleotide
  Target: ATXN1; (-) strand; PAM type: NNNNGHTT; PAM sequence: TACGGCTT
ttggaactagaaccgacact

SEQ ID NO: 26624 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
tgacaggacctgttactgac

SEQ ID NO: 26625 - DNA, 20 bp, Artificial Sequence
  Description of Artificial Sequence: Synthetic oligonucleotide
  Target: ATXN1; (-) strand; PAM type: NNNNGHTT; PAM sequence: GTGGGATT
tgcctcggcctcccaaagtg

SEQ ID NO: 26626 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttatatttttagtagaga

SEQ ID NO: 26627 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcctgattag

SEQ ID NO: 26628 - DNA, 20 bp, Artificial Sequence
  Description of Artificial Sequence: Synthetic oligonucleotide
  Target: ATXN1; (-) strand; PAM type: NNNNGHTT; PAM sequence: TCCTGATT
gtgattctcctgcctcagcc

SEQ ID NO: 26629 - DNA, 20 bp, Artificial Sequence
  Description of Artificial Sequence: Synthetic oligonucleotide
  Target: ATXN1; (-) strand; PAM type: NNNNGHTT; PAM sequence: ATGTGATT
aacctccgcctcccaggttc

SEQ ID NO: 26630 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
ttttcatctgaatagtgttt

SEQ ID NO: 26631 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
tataatagttttcatctgaa

SEQ ID NO: 26632 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
aaatagtaatctataaatat

SEQ ID NO: 26633 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
gcattataggtaattcaaag

SEQ ID NO: 26634 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
gggcagccatgtttgagaac

SEQ ID NO: 26635 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
atggtgattctgatgggcag

SEQ ID NO: 26636 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
gtgtttcctaaaaggcacaa

SEQ ID NO: 26637 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
gactgcaaatgtctgagaat

SEQ ID NO: 26638 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
tgatcagaatcccttggggg

SEQ ID NO: 26639 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
cagttgtttgccttcagagt

SEQ ID NO: 26640 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
cctgaaaactctctcttgcc

SEQ ID NO: 26641 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
aaagtctagttcataggaca

SEQ ID NO: 26642 - DNA, 20 bp, Artificial Sequence
  Description of Artificial Sequence: Synthetic oligonucleotide
  Target: ATXN1; (-) strand; PAM type: NNNNGHTT; PAM sequence: CCATGCTT
ccttgcacagcctcttcctg

SEQ ID NO: 26643 - DNA, 20 bp, Artificial Sequence
  Description of Artificial Sequence: Synthetic oligonucleotide
  Target: ATXN1; (-) strand; PAM type: NNNNGHTT; PAM sequence: AAGGGATT
cagagaaataaaaagactga

SEQ ID NO: 26644 - DNA, 20 bp, Artificial Sequence
  Description of Artificial Sequence: Synthetic oligonucleotide
  Target: ATXN1; (-) strand; PAM type: NNNNGHTT; PAM sequence: CTGGGCTT
gccttctcccctccaggctg

SEQ ID NO: 26645 - DNA, 20 bp, Artificial Sequence
  Description of Artificial Sequence: Synthetic oligonucleotide
  Target: ATXN1; (-) strand; PAM type: NNNNGHTT; PAM sequence: GCTGGATT
ctgatcctggtaacctgact

SEQ ID NO: 26646 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
atagagtttctgccacccag

SEQ ID NO: 26647 - DNA, 20 bp, Artificial Sequence
  Description of Artificial Sequence: Synthetic oligonucleotide
  Target: ATXN1; (-) strand; PAM type: NNNNGHTT; PAM sequence: TAGAGTTT
atgtttcctttggggtatca

SEQ ID NO: 26648 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
tgaccacctctgagaagagt

SEQ ID NO: 26649 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
tctgctgccaaccaggcagg

SEQ ID NO: 26650 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
ggggaagccaagttctgtct

SEQ ID NO: 26651 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
ctaaaagattgttaagacta

SEQ ID NO: 26652 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
ttgctactaaggtcaggtct

SEQ ID NO: 26653 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
acttttatgactggcagtta

SEQ ID NO: 26654 - DNA, 20 bp, Artificial Sequence
  Description of Artificial Sequence: Synthetic oligonucleotide
  Target: ATXN1; (-) strand; PAM type: NNNNGHTT; PAM sequence: CACCGCTT
gttgcagggagccaagatta

SEQ ID NO: 26655 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
aaggcggaggttgcagggag

SEQ ID NO: 26656 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
tcaggaggctgaggcaggag

SEQ ID NO: 26657 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
actttgagaaccactgtctt

SEQ ID NO: 26658 - DNA, 20 bp, Artificial Sequence
  Description of Artificial Sequence: Synthetic oligonucleotide
  Target: ATXN1; (-) strand; PAM type: NNNNGHTT; PAM sequence: TGCCGCTT
aagtttacaggtgatcatga

SEQ ID NO: 26659 - DNA, 20 bp, Artificial Sequence
  Description of Artificial Sequence: Synthetic oligonucleotide
  Target: ATXN1; (-) strand; PAM type: NNNNGHTT; PAM sequence: ACAAGTTT
cccaagaatttgcatttgta

SEQ ID NO: 26660 - DNA, 20 bp, Artificial Sequence
  Description of Artificial Sequence: Synthetic oligonucleotide
  Target: ATXN1; (-) strand; PAM type: NNNNGHTT; PAM sequence: CACAGATT
gcctggaggacttgttcaaa

SEQ ID NO: 26661 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
atggttcttacttcattttg

SEQ ID NO: 26662 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
aaagtcaatatgtgcttgtg

SEQ ID NO: 26663 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
gcaaaaaagtcaatatgtgc

SEQ ID NO: 26664 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
tattaagcaaaaaagtcaat

SEQ ID NO: 26665 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
attaaaaatttaaaaagcca

SEQ ID NO: 26666 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgggaggattgcttgagccc

SEQ ID NO: 26667 - DNA, 20 bp, Artificial Sequence
  Description of Artificial Sequence: Synthetic oligonucleotide
  Target: ATXN1; (-) strand; PAM type: NNNNGHTT; PAM sequence: GATTGCTT
tcaggaggctgatgtgggag

SEQ ID NO: 26668 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
ctactcaggaggctgatgtg

SEQ ID NO: 26669 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
tggaagctaagtagtgcatt

SEQ ID NO: 26670 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
caccttggcctcccaaagtg

SEQ ID NO: 26671 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
tacactttattgtaatacag

SEQ ID NO: 26672 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
ttacaaaaaaaaaaaaaaaa

SEQ ID NO: 26673 - DNA, 20 bp, Artificial Sequence
  Description of Artificial Sequence: Synthetic oligonucleotide
  Target: ATXN1; (-) strand; PAM type: NNNNGHTT; PAM sequence: TCGGGCTT
tcctagatgtgtgttaggca

SEQ ID NO: 26674 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
aaaaatggccggtggagaac

SEQ ID NO: 26675 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
ttctagaaaatattcccaag

SEQ ID NO: 26676 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
tctcataacaaagaactgat

SEQ ID NO: 26677 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
taagaaaattagtattgaaa

SEQ ID NO: 26678 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
gcgtggaaaatgcagtcata

SEQ ID NO: 26679 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
cagacctggctccaacatgc

SEQ ID NO: 26680 - DNA, 20 bp, Artificial Sequence
  Description of Artificial Sequence: Synthetic oligonucleotide
  Target: ATXN1; (-) strand; PAM type: NNNNGHTT; PAM sequence: TCAAGCTT
ctatgttgaacgcttggctg

SEQ ID NO: 26681 - DNA, 20 bp, Artificial Sequence
  Description of Artificial Sequence: Synthetic oligonucleotide
  Target: ATXN1; (-) strand; PAM type: NNNNGHTT; PAM sequence: GAACGCTT
tttttaacattggctatgtt

SEQ ID NO: 26682 - DNA, 20 bp, Artificial Sequence
  Description of Artificial Sequence: Synthetic oligonucleotide
  Target: ATXN1; (-) strand; PAM type: NNNNGHTT; PAM sequence: ATAAGTTT
ttaatataatttattaaacc

SEQ ID NO: 26683 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
cgggtgatccgcctcgcctc

SEQ ID NO: 26684 - DNA, 20 bp, Artificial Sequence
  Description of Artificial Sequence: Synthetic oligonucleotide
  Target: ATXN1; (-) strand; PAM type: NNNNGHTT; PAM sequence: ACGGGATT
attttgtatttttagtagag

SEQ ID NO: 26685 - DNA, 20 bp, Artificial Sequence
  Description of Artificial Sequence: Synthetic oligonucleotide
  Target: ATXN1; (-) strand; PAM type: NNNNGHTT; PAM sequence: GTGTGATT
ctgcctcagcctcctgagta

SEQ ID NO: 26686 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctccacctcccgggttc

SEQ ID NO: 26687 - DNA, 20 bp, Artificial Sequence
  Description of Artificial Sequence: Synthetic oligonucleotide
  Target: ATXN1; (-) strand; PAM type: NNNNGHTT; PAM sequence: CGGAGTTT
ttttttttttttttttgaga

SEQ ID NO: 26688 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tgatgagtttttgtttttgt

SEQ ID NO: 26689 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
aatgagggatgatgatgagt

SEQ ID NO: 26690 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
gagtaaaatgagggatgatg

SEQ ID NO: 26691 - DNA, 20 bp, Artificial Sequence
  Description of Artificial Sequence: Synthetic oligonucleotide
  Target: ATXN1; (-) strand; PAM type: NNNNGHTT; PAM sequence: GGACGTTT
tttataggactggcactgca

SEQ ID NO: 26692 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
caccttggcctcccaaagtg

SEQ ID NO: 26693 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
tttttgtatttttagtagag

SEQ ID NO: 26694 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tgcctcagccacccgaagag

SEQ ID NO: 26695 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctccgactccctggttc

SEQ ID NO: 26696 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
cctgaggctgtttacagtta

SEQ ID NO: 26697 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
ctccagagggacctgcctga

SEQ ID NO: 26698 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
ttaaaaaaagtttttttttt

SEQ ID NO: 26699 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
ataagctttttcttattaaa

SEQ ID NO: 26700 - DNA, 20 bp, Artificial Sequence
  Description of Artificial Sequence: Synthetic oligonucleotide
  Target: ATXN1; (-) strand; PAM type: NNNNGHTT; PAM sequence: ATAAGCTT
tacaccaccacatccagttt

SEQ ID NO: 26701 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
tacaggtgtacaccaccaca

SEQ ID NO: 26702 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaaaatg

SEQ ID NO: 26703 - DNA, 20 bp, Artificial Sequence
  Description of Artificial Sequence: Synthetic oligonucleotide
  Target: ATXN1; (-) strand; PAM type: NNNNGHTT; PAM sequence: GCTGGTTT
agtctcactatgttgcccag

SEQ ID NO: 26704 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
tttatatctttattctataa

SEQ ID NO: 26705 - DNA, 20 bp, Artificial Sequence
  Description of Artificial Sequence: Synthetic oligonucleotide
  Target: ATXN1; (-) strand; PAM type: NNNNGHTT; PAM sequence: ATAAGCTT
tttctttatatctttattct

SEQ ID NO: 26706 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
tgataactttcataatagca

SEQ ID NO: 26707 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
ttgataataaattaaccacg

SEQ ID NO: 26708 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gtacacttaggctacactaa

SEQ ID NO: 26709 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
gactgtacacttaggctaca

SEQ ID NO: 26710 - DNA, 20 bp, Artificial Sequence
  Description of Artificial Sequence: Synthetic oligonucleotide
  Target: ATXN1; (-) strand; PAM type: NNNNGHTT; PAM sequence: TGGAGCTT
tatagggcacttaccatgaa

SEQ ID NO: 26711 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
gtacagtaaaaatgaagtag

SEQ ID NO: 26712 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
tgtaacacaatgttcctaaa

SEQ ID NO: 26713 - DNA, 20 bp, Artificial Sequence
  Description of Artificial Sequence: Synthetic oligonucleotide
  Target: ATXN1; (-) strand; PAM type: NNNNGHTT; PAM sequence: TTACGATT
atacaaacttggacataggg

SEQ ID NO: 26714 - DNA, 20 bp, Artificial Sequence
  Description of Artificial Sequence: Synthetic oligonucleotide
  Target: ATXN1; (-) strand; PAM type: NNNNGHTT; PAM sequence: ATGAGATT
ccaatgtgacattaccaacc

SEQ ID NO: 26715 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
gacgtttgatttgtagcatt

SEQ ID NO: 26716 - DNA, 20 bp, Artificial Sequence
  Description of Artificial Sequence: Synthetic oligonucleotide
  Target: ATXN1; (-) strand; PAM type: NNNNGHTT; PAM sequence: GTTTGATT
tggctcgggaataacaggac

SEQ ID NO: 26717 - DNA, 20 bp, Artificial Sequence
  Description of Artificial Sequence: Synthetic oligonucleotide
  Target: ATXN1; (-) strand; PAM type: NNNNGHTT; PAM sequence: GGACGTTT
ctactggctcgggaataaca

SEQ ID NO: 26718 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
aaaaaacaaaaaacaaaaca

SEQ ID NO: 26719 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
caggcagatcacctgaggtc

SEQ ID NO: 26720 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
gataccagcagtgtgctgat

SEQ ID NO: 26721 - DNA, 20 bp, Artificial Sequence
  Description of Artificial Sequence: Synthetic oligonucleotide
  Target: ATXN1; (-) strand; PAM type: NNNNGHTT; PAM sequence: TATGGCTT
acagcaatgatttggtggca

SEQ ID NO: 26722 - DNA, 20 bp, Artificial Sequence
  Description of Artificial Sequence: Synthetic oligonucleotide
  Target: ATXN1; (-) strand; PAM type: NNNNGHTT; PAM sequence: CAATGATT
tagttggaaactctggacag

SEQ ID NO: 26723 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
aacagagggagtaaatcagc

SEQ ID NO: 26724 - DNA, 20 bp, Artificial Sequence
  Description of Artificial Sequence: Synthetic oligonucleotide
  Target: ATXN1; (-) strand; PAM type: NNNNGHTT; PAM sequence: GACTGATT
acaattacatttctgagtca

SEQ ID NO: 26725 - DNA, 20 bp, Artificial Sequence
  Description of Artificial Sequence: Synthetic oligonucleotide
  Target: ATXN1; (-) strand; PAM type: NNNNGHTT; PAM sequence: TGGCGTTT
aggatgatacaaatatccag

SEQ ID NO: 26726 - DNA, 20 bp, Artificial Sequence
  Description of Artificial Sequence: Synthetic oligonucleotide
  Target: ATXN1; (-) strand; PAM type: NNNNGHTT; PAM sequence: TCTGGATT
aagaatacaagatttggatt

SEQ ID NO: 26727 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
aaagtctaaagaatacaaga

SEQ ID NO: 26728 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
tgtggtaaagtctaaagaat

SEQ ID NO: 26729 - DNA, 20 bp, Artificial Sequence
  Description of Artificial Sequence: Synthetic oligonucleotide
  Target: ATXN1; (-) strand; PAM type: NNNNGHTT; PAM sequence: GACAGATT
aaaaaaagtcccattttcat

SEQ ID NO: 26730 - DNA, 20 bp, Artificial Sequence
  Description of Artificial Sequence: Synthetic oligonucleotide
  Target: ATXN1; (-) strand; PAM type: NNNNGHTT; PAM sequence: GGGAGCTT
tttctgcctttgggcaggaa

SEQ ID NO: 26731 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
tcaggtggaagtgtgtttgc

SEQ ID NO: 26732 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
ctttaggaattcaggtggaa

SEQ ID NO: 26733 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
tagatgccttaggcttctct

SEQ ID NO: 26734 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
ttgaatttaaattagatgcc

SEQ ID NO: 26735 - DNA, 20 bp, Artificial Sequence
  Description of Artificial Sequence: Synthetic oligonucleotide
  Target: ATXN1; (-) strand; PAM type: NNNNGHTT; PAM sequence: TCACGATT
caagaacttggattctttat

SEQ ID NO: 26736 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
ttcaccattaagtgcaagaa

SEQ ID NO: 26737 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tgtatatgtgtatgtatata

SEQ ID NO: 26738 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
tacgtgtatatgtgtatgta

SEQ ID NO: 26739 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
tgtacatatctgataaaagg

SEQ ID NO: 26740 - DNA, 20 bp, Artificial Sequence
  Description of Artificial Sequence: Synthetic oligonucleotide
  Target: ATXN1; (-) strand; PAM type: NNNNGHTT; PAM sequence: CCAGGATT
aagcattcttcacatttttc

SEQ ID NO: 26741 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
cagtgttgtgtttttactgg

SEQ ID NO: 26742 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
gctacaattcataagcagtg

SEQ ID NO: 26743 - DNA, 20 bp, Artificial Sequence
  Description of Artificial Sequence: Synthetic oligonucleotide
  Target: ATXN1; (-) strand; PAM type: NNNNGHTT; PAM sequence: ACAGGATT
caaagaaaacctacctccaa

SEQ ID NO: 26744 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
gctggagtcgtgagacggag

SEQ ID NO: 26745 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
aatgtgttgagaaaacatct

SEQ ID NO: 26746 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
tttgcctttgtgatggttag

SEQ ID NO: 26747 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
ctgacaaggggacagatggg

SEQ ID NO: 26748 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
aaatcctgacaaggggacag

SEQ ID NO: 26749 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
cttttgttacacggcctcca

SEQ ID NO: 26750 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
gcgccttggccctatttgct

SEQ ID NO: 26751 - DNA, 20 bp, Artificial Sequence
  Description of Artificial Sequence: Synthetic oligonucleotide
  Target: ATXN1; (-) strand; PAM type: NNNNGHTT; PAM sequence: GCCTGATT
gtgtttgcctttatttgacg

SEQ ID NO: 26752 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
tgtctttagaaatgttgaga

SEQ ID NO: 26753 - DNA, 20 bp, Artificial Sequence
  Description of Artificial Sequence: Synthetic oligonucleotide
  Target: ATXN1; (-) strand; PAM type: NNNNGHTT; PAM sequence: ATATGCTT
gcagaaatgacttaagtctg

SEQ ID NO: 26754 - DNA, 20 bp, Artificial Sequence
  Description of Artificial Sequence: Synthetic oligonucleotide
  Target: ATXN1; (-) strand; PAM type: NNNNGHTT; PAM sequence: CCCCGCTT
gagaattatgtgtcttccct

SEQ ID NO: 26755 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
aggtgtcccttgcagagcaa

SEQ ID NO: 26756 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
ctctggctgcagctgatctt

SEQ ID NO: 26757 - DNA, 20 bp, Artificial Sequence
  Description of Artificial Sequence: Synthetic oligonucleotide
  Target: ATXN1; (-) strand; PAM type: NNNNGHTT; PAM sequence: TAGCGTTT
gctgtgggccatggtgaggc

SEQ ID NO: 26758 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tctgtcagtctgggtgggac

SEQ ID NO: 26759 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
gaggtctgtctggtgcttct

SEQ ID NO: 26760 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
ataggtgagagaggtctgtc

SEQ ID NO: 26761 - DNA, 20 bp, Artificial Sequence
  Description of Artificial Sequence: Synthetic oligonucleotide
  Target: ATXN1; (-) strand; PAM type: NNNNGHTT; PAM sequence: ACTAGATT
caagaagagagctacttttt

SEQ ID NO: 26762 - DNA, 20 bp, Artificial Sequence
  Description of Artificial Sequence: Synthetic oligonucleotide
  Target: ATXN1; (-) strand; PAM type: NNNNGHTT; PAM sequence: AGGGGCTT
gtagccacggagccctgaac

SEQ ID NO: 26763 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
ccatgatccaggtacctaga

SEQ ID NO: 26764 - DNA, 20 bp, Artificial Sequence
  Description of Artificial Sequence: Synthetic oligonucleotide
  Target: ATXN1; (-) strand; PAM type: NNNNGHTT; PAM sequence: ATTGGATT
gaaagagacacatcataaat

SEQ ID NO: 26765 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
tgaccttctttgagcttttc

SEQ ID NO: 26766 - DNA, 20 bp, Artificial Sequence
  Description of Artificial Sequence: Synthetic oligonucleotide
  Target: ATXN1; (-) strand; PAM type: NNNNGHTT; PAM sequence: TTGAGCTT
aaagtagaccatgaccttct

SEQ ID NO: 26767 - DNA, 20 bp, Artificial Sequence
  Description of Artificial Sequence: Synthetic oligonucleotide
  Target: ATXN1; (-) strand; PAM type: NNNNGHTT; PAM sequence: CACGGATT
tctttatttttcttcatttc

SEQ ID NO: 26768 - DNA, 20 bp, Artificial Sequence
  Description of Artificial Sequence: Synthetic oligonucleotide
  Target: ATXN1; (-) strand; PAM type: NNNNGHTT; PAM sequence: ATAAGTTT
aggacactggacactttaaa

SEQ ID NO: 26769 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
gccacttccaggtttcaagg

SEQ ID NO: 26770 - DNA, 20 bp, Artificial Sequence
  Description of Artificial Sequence: Synthetic oligonucleotide
  Target: ATXN1; (-) strand; PAM type: NNNNGHTT; PAM sequence: CCAGGTTT
gtagacctggaaagccactt

SEQ ID NO: 26771 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
tgtgtaaagagacgggcaaa

SEQ ID NO: 26772 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
acaggtgtgagcctggtccc

SEQ ID NO: 26773 - DNA, 20 bp, Artificial Sequence
  Description of Artificial Sequence: Synthetic oligonucleotide
  Target: ATXN1; (-) strand; PAM type: NNNNGHTT; PAM sequence: CCAGGATT
tgcctcagcttcccaaaaca

SEQ ID NO: 26774 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
gtgtcaagtgatcctcctgc

SEQ ID NO: 26775 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
ttttagagtcaagggtctca

SEQ ID NO: 26776 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
attttttttaaatttttaaa

SEQ ID NO: 26777 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
gtcctagccacagctctctc

SEQ ID NO: 26778 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
atggaggcaaaatctgccaa

SEQ ID NO: 26779 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
ggttgagaaaatgtagcagc

SEQ ID NO: 26780 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
cttgccttccaccatgattg

SEQ ID NO: 26781 - DNA, 20 bp, Artificial Sequence
  Description of Artificial Sequence: Synthetic oligonucleotide
  Target: ATXN1; (-) strand; PAM type: NNNNGHTT; PAM sequence: CCATGATT
ttgctcctccttgccttcca

SEQ ID NO: 26782 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
ggataagtctcacgagatct

SEQ ID NO: 26783 - DNA, 20 bp, Artificial Sequence
  Description of Artificial Sequence: Synthetic oligonucleotide
  Target: ATXN1; (-) strand; PAM type: NNNNGHTT; PAM sequence: CCCAGATT
atggtttggctgtgtccctg

SEQ ID NO: 26784 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
ccatatagatcaactgatga

SEQ ID NO: 26785 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tgtcagtggttggcgagaag

SEQ ID NO: 26786 - DNA, 20 bp, Artificial Sequence
  Description of Artificial Sequence: Synthetic oligonucleotide
  Target: ATXN1; (-) strand; PAM type: NNNNGHTT; PAM sequence: CCCTGTTT
ctctggcctatgcacattgt

SEQ ID NO: 26787 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
tgctataagccagttgtctc

SEQ ID NO: 26788 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
gtctctcctcttctgttgtt

SEQ ID NO: 26789 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
agtgggaaagatctcataag

SEQ ID NO: 26790 - DNA, 20 bp, Artificial Sequence
  Description of Artificial Sequence: Synthetic oligonucleotide
  Target: ATXN1; (-) strand; PAM type: NNNNGHTT; PAM sequence: AACAGCTT
gatcctcccttgaaaggagg

SEQ ID NO: 26791 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
cgtttgatgtaggagagcaa

SEQ ID NO: 26792 - DNA, 20 bp, Artificial Sequence
  Description of Artificial Sequence: Synthetic oligonucleotide
  Target: ATXN1; (-) strand; PAM type: NNNNGHTT; PAM sequence: TAACGTTT
ttttttctgtggagttaaga

SEQ ID NO: 26793 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
cctcctctggttgtcaagag

SEQ ID NO: 26794 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
gttaaaaaaaattcactatc

SEQ ID NO: 26795 - DNA, 20 bp, Artificial Sequence
  Description of Artificial Sequence: Synthetic oligonucleotide
  Target: ATXN1; (-) strand; PAM type: NNNNGHTT; PAM sequence: CGCTGTTT
aagatgttcaaaattcaaag

SEQ ID NO: 26796 - DNA, 20 bp, Artificial Sequence
  Description of Artificial Sequence: Synthetic oligonucleotide
  Target: ATXN1; (-) strand; PAM type: NNNNGHTT; PAM sequence: CTAGGTTT
ccaaagttgaacttggtctg

SEQ ID NO: 26797 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
tcaacctcttgcccgtgtgt

SEQ ID NO: 26798 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
gggatttcaacctcttgccc

SEQ ID NO: 26799 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tcagctgagaagccgaggac

SEQ ID NO: 26800 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
tcttaaaaaattttttttta

SEQ ID NO: 26801 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
aaggtcaaggctgaagtgag

SEQ ID NO: 26802 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
ttaaggggctgaagcaggag

SEQ ID NO: 26803 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
tatgaaagttgctgcattta

SEQ ID NO: 26804 - DNA, 20 bp, Artificial Sequence
  Description of Artificial Sequence: Synthetic oligonucleotide
  Target: ATXN1; (-) strand; PAM type: NNNNGHTT; PAM sequence: GAGAGTTT
gtgctttttttcaggatgag

SEQ ID NO: 26805 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
agattgtccattcctgctgt

SEQ ID NO: 26806 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
tcacatgcagccccacaacc

SEQ ID NO: 26807 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
gggagagtatgttattgtct

SEQ ID NO: 26808 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
tctatattgtcatatttact

SEQ ID NO: 26809 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
tcagcatttttcctatcact

SEQ ID NO: 26810 - DNA, 20 bp, Artificial Sequence
  Description of Artificial Sequence: Synthetic oligonucleotide
  Target: ATXN1; (-) strand; PAM type: NNNNGHTT; PAM sequence: GATAGTTT
gtaaagagtcatatgtttaa

SEQ ID NO: 26811 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
ccttttttgggtaaagagtc

SEQ ID NO: 26812 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
tgttcctgcctcttaaatct

SEQ ID NO: 26813 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
gagtcccatcaggacagaac

SEQ ID NO: 26814 - DNA, 20 bp, Artificial Sequence
  Description of Artificial Sequence: Synthetic oligonucleotide
  Target: ATXN1; (-) strand; PAM type: NNNNGHTT; PAM sequence: GACAGCTT
cacatgtggtgggggctggg

SEQ ID NO: 26815 - DNA, 20 bp, Artificial Sequence
  Description of Artificial Sequence: Synthetic oligonucleotide
  Target: ATXN1; (-) strand; PAM type: NNNNGHTT; PAM sequence: ACGTGATT
ctagaaacaggtgagtggag

SEQ ID NO: 26816 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
aatagtgctgaatgaaggaa

SEQ ID NO: 26817 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
caagccccacacagtagcat

SEQ ID NO: 26818 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
cagagacccaaatgagaaag

SEQ ID NO: 26819 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
taatcaaaagttggctacag

SEQ ID NO: 26820 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
tgtagcaaactgctaggact

SEQ ID NO: 26821 - DNA, 20 bp, Artificial Sequence
  Description of Artificial Sequence: Synthetic oligonucleotide
  Target: ATXN1; (-) strand; PAM type: NNNNGHTT; PAM sequence: AGTCGTTT
gttcctaactctcactacgt

SEQ ID NO: 26822 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
tattgcttcctgcatcacca

SEQ ID NO: 26823 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
gcttttcaaacagattgttt

SEQ ID NO: 26824 - DNA, 20 bp, Artificial Sequence
  Description of Artificial Sequence: Synthetic oligonucleotide
  Target: ATXN1; (-) strand; PAM type: NNNNGHTT; PAM sequence: GATTGTTT
aaacctgtgcttttcaaaca

SEQ ID NO: 26825 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
tatgaaacctgtgcttttca

SEQ ID NO: 26826 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
gcgctaacattttatgaaac

SEQ ID NO: 26827 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
ttgcaagagttcatctctga

SEQ ID NO: 26828 - DNA, 20 bp, Artificial Sequence
  Description of Artificial Sequence: Synthetic oligonucleotide
  Target: ATXN1; (-) strand; PAM type: NNNNGHTT; PAM sequence: GAGTGCTT
tttggatgcttcggccgcca

SEQ ID NO: 26829 - DNA, 20 bp, Artificial Sequence
  Description of Artificial Sequence: Synthetic oligonucleotide
  Target: ATXN1; (-) strand; PAM type: NNNNGHTT; PAM sequence: GGATGCTT
accacagcaaccaggaattt

SEQ ID NO: 26830 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
atttaatgtcttcagctgag

SEQ ID NO: 26831 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
gcaagagaaatagctcaaac

SEQ ID NO: 26832 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
ataaggctgtgaagagagag

SEQ ID NO: 26833 - DNA, 20 bp, Artificial Sequence
  Description of Artificial Sequence: Synthetic oligonucleotide
  Target: ATXN1; (-) strand; PAM type: NNNNGHTT; PAM sequence: GTATGATT
tttaacttgggttctccttg

SEQ ID NO: 26834 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
aagctttatttaaagtttta

SEQ ID NO: 26835 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
aaaccaaataaagctttatt

SEQ ID NO: 26836 - DNA, 20 bp, Artificial Sequence
  Description of Artificial Sequence: Synthetic oligonucleotide
  Target: ATXN1; (-) strand; PAM type: NNNNGHTT; PAM sequence: TAAAGCTT
tggctgtgagtaaaaccaaa

SEQ ID NO: 26837 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
ttatgaatgcccggtatccg

SEQ ID NO: 26838 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
agcacaggtctttgaataaa

SEQ ID NO: 26839 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
ggagctaagaacataaagta

SEQ ID NO: 26840 - DNA, 20 bp, Artificial Sequence
  Description of Artificial Sequence: Synthetic oligonucleotide
  Target: ATXN1; (-) strand; PAM type: NNNNGHTT; PAM sequence: GCTTGCTT
ggaacaggctatgacctaat

SEQ ID NO: 26841 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
aagaggaacaggctatgacc

SEQ ID NO: 26842 - DNA, 20 bp, Artificial Sequence
  Description of Artificial Sequence: Synthetic oligonucleotide
  Target: ATXN1; (-) strand; PAM type: NNNNGHTT; PAM sequence: AGCAGCTT
tgtatttgtcccgaatggct

SEQ ID NO: 26843 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
gcgtccaccctactgctatg

SEQ ID NO: 26844 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
gcagaaagggtacacttgcc

SEQ ID NO: 26845 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
gtacacatcttaagtgttag

SEQ ID NO: 26846 - DNA, 20 bp, Artificial Sequence
  Description of Artificial Sequence: Synthetic oligonucleotide
  Target: ATXN1; (-) strand; PAM type: NNNNGHTT; PAM sequence: ATCTGATT
gccgctgtgaacttttacaa

SEQ ID NO: 26847 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tttaaaaaatttaataatgt

SEQ ID NO: 26848 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
tttcaatgtgccattggaag

SEQ ID NO: 26849 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
actatgagaaggtcatctct

SEQ ID NO: 26850 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
gatacagatacttttgagga

SEQ ID NO: 26851 - DNA, 20 bp, Artificial Sequence
  Description of Artificial Sequence: Synthetic oligonucleotide
  Target: ATXN1; (-) strand; PAM type: NNNNGHTT; PAM sequence: ACCAGCTT
aaccagatgttgtgagtaaa

SEQ ID NO: 26852 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
actggcctgggatttaagag

SEQ ID NO: 26853 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
aatgatgaaaagctactggc

SEQ ID NO: 26854 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
ctgcagctcagaccctccaa

SEQ ID NO: 26855 - DNA, 20 bp, Artificial Sequence
  Description of Artificial Sequence: Synthetic oligonucleotide
  Target: ATXN1; (-) strand; PAM type: NNNNGHTT; PAM sequence: ACCTGATT
tccagagatgcccagatgag

SEQ ID NO: 26856 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
ctggcaggtttcctgtcact

SEQ ID NO: 26857 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
acatggcaccattatccctg

SEQ ID NO: 26858 - DNA, 20 bp, Artificial Sequence
  Description of Artificial Sequence: Synthetic oligonucleotide
  Target: ATXN1; (-) strand; PAM type: NNNNGHTT; PAM sequence: TCCCGTTT
tctcgaatgttattatcaac

SEQ ID NO: 26859 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
ttaaaggagacacgaagtaa

SEQ ID NO: 26860 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
aggccactatttaaaataac

SEQ ID NO: 26861 - DNA, 20 bp, Artificial Sequence
  Description of Artificial Sequence: Synthetic oligonucleotide
  Target: ATXN1; (-) strand; PAM type: NNNNGHTT; PAM sequence: GCAGGCTT
tgggagaaatcagtgtgaaa

SEQ ID NO: 26862 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
gttgtgagaaaataaatgtc

SEQ ID NO: 26863 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
agagacctcaactctaaaaa

SEQ ID NO: 26864 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
caggaggatcgcttgaaccc

SEQ ID NO: 26865 - DNA, 20 bp, Artificial Sequence
  Description of Artificial Sequence: Synthetic oligonucleotide
  Target: ATXN1; (-) strand; PAM type: NNNNGHTT; PAM sequence: GATCGCTT
tcagcagactgagacaggag

SEQ ID NO: 26866 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
agaatgaggctcattgcacc

SEQ ID NO: 26867 - DNA, 20 bp, Artificial Sequence
  Description of Artificial Sequence: Synthetic oligonucleotide
  Target: ATXN1; (-) strand; PAM type: NNNNGHTT; PAM sequence: ACCAGTTT
aaatgactgaggtatactta

SEQ ID NO: 26868 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
tgacattatttgattataat

SEQ ID NO: 26869 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
aatatcgatcctgtgacatt

SEQ ID NO: 26870 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
aaatatcggggcaaaactga

SEQ ID NO: 26871 - DNA, 20 bp, Artificial Sequence
  Description of Artificial Sequence: Synthetic oligonucleotide
  Target: ATXN1; (-) strand; PAM type: NNNNGHTT; PAM sequence: AGCAGCTT
aaggcaattgtgtggaacag

SEQ ID NO: 26872 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
agttactgtggttttttttt

SEQ ID NO: 26873 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
ctcataacaactacagttac

SEQ ID NO: 26874 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
tgcctctgcctcccaaagtg

SEQ ID NO: 26875 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
ccacctgcctctgcctccca

SEQ ID NO: 26876 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
ttttgtatttttagtagaga

SEQ ID NO: 26877 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
acaattttagacctacaaaa

SEQ ID NO: 26878 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
gccccagattctgcacgtct

SEQ ID NO: 26879 - DNA, 20 bp, Artificial Sequence
  Description of Artificial Sequence: Synthetic oligonucleotide
  Target: ATXN1; (-) strand; PAM type: NNNNGHTT; PAM sequence: CCCAGATT
ggtggggggcaaagaagagc

SEQ ID NO: 26880 - DNA, 20 bp, Artificial Sequence
  Description of Artificial Sequence: Synthetic oligonucleotide
  Target: ATXN1; (-) strand; PAM type: NNNNGHTT; PAM sequence: CGCTGTTT
tgtggaacttctctagaact

SEQ ID NO: 26881 - DNA, 20 bp, Artificial Sequence
  Description of Artificial Sequence: Synthetic oligonucleotide
  Target: ATXN1; (-) strand; PAM type: NNNNGHTT; PAM sequence: CACAGTTT
cagaaggccagcaggtggag

SEQ ID NO: 26882 - DNA, 20 bp, Artificial Sequence
  Description of Artificial Sequence: Synthetic oligonucleotide
  Target: ATXN1; (-) strand; PAM type: NNNNGHTT; PAM sequence: CGCAGCTT
accagcatcatcagcccaga

SEQ ID NO: 26883 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
tggacaaactcaaatctgtt

SEQ ID NO: 26884 - DNA, 20 bp, Artificial Sequence
  Description of Artificial Sequence: Synthetic oligonucleotide
  Target: ATXN1; (-) strand; PAM type: NNNNGHTT; PAM sequence: GCATGCTT
ggttaattttcaagtaccaa

SEQ ID NO: 26885 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
gtgatttgatgctcatcttt

SEQ ID NO: 26886 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
tcatgctctccatgcacgtc

SEQ ID NO: 26887 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
ggtagggctccggtgccacc

SEQ ID NO: 26888 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
ggaaggagggccgctagatg

SEQ ID NO: 26889 - DNA, 20 bp, Artificial Sequence
  Description of Artificial Sequence: Synthetic oligonucleotide
  Target: ATXN1; (-) strand; PAM type: NNNNGHTT; PAM sequence: ACTGGATT
tagtgggtcttacatcatca

SEQ ID NO: 26890 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
agcacttgtttggttctcta

SEQ ID NO: 26891 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
tccataggggtcccttcagc

SEQ ID NO: 26892 - DNA, 20 bp, Artificial Sequence
  Description of Artificial Sequence: Synthetic oligonucleotide
  Target: ATXN1; (-) strand; PAM type: NNNNGHTT; PAM sequence: GTCAGATT
cctgctcctcacctttgtaa

SEQ ID NO: 26893 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
atgttagaaagaatcctcaa

SEQ ID NO: 26894 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
aaaacaaatgattgcaccct

SEQ ID NO: 26895 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
aaagaagattctagtaaaac

SEQ ID NO: 26896 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
attaagactttagaacataa

SEQ ID NO: 26897 - DNA, 20 bp, Artificial Sequence
  Description of Artificial Sequence: Synthetic oligonucleotide
  Target: ATXN1; (-) strand; PAM type: NNNNGHTT; PAM sequence: GCATGATT
gctcacaatttgaaagaaat

SEQ ID NO: 26898 - DNA, 20 bp, Artificial Sequence
  Description of Artificial Sequence: Synthetic oligonucleotide
  Target: ATXN1; (-) strand; PAM type: NNNNGHTT; PAM sequence: ACAAGCTT
cctgaatagatgtaattctg

SEQ ID NO: 26899 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcattggcctcccaaagag

SEQ ID NO: 26900 - DNA, 20 bp, Artificial Sequence
  Description of Artificial Sequence: Synthetic oligonucleotide
  Target: ATXN1; (-) strand; PAM type: NNNNGHTT; PAM sequence: CGTGGTTT
ttttgtatttttggtagaga

SEQ ID NO: 26901 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ttcagcaagcatctttaggc

SEQ ID NO: 26902 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
gctgatttcagcaagcatct

SEQ ID NO: 26903 - DNA, 20 bp, Artificial Sequence
  Description of Artificial Sequence: Synthetic oligonucleotide
  Target: ATXN1; (-) strand; PAM type: NNNNGHTT; PAM sequence: AGCTGATT
cctgaagagaacagactaat

SEQ ID NO: 26904 - DNA, 20 bp, Artificial Sequence
  Description of Artificial Sequence: Synthetic oligonucleotide
  Target: ATXN1; (-) strand; PAM type: NNNNGHTT; PAM sequence: CAGGGCTT
ctctgagtaccacctataaa

SEQ ID NO: 26905 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
cttaaatcctgatgcagcca

SEQ ID NO: 26906 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
cccccaggccagctatgggc

SEQ ID NO: 26907 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
acaaagaagaaggcttttag

SEQ ID NO: 26908 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
aaaacatgcacaacaaagaa

SEQ ID NO: 26909 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
ttcaaactaaatttcttgtt

SEQ ID NO: 26910 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
gatttatttcaaactaaatt

SEQ ID NO: 26911 - DNA, 20 bp, Artificial Sequence
  Description of Artificial Sequence: Synthetic oligonucleotide
  Target: ATXN1; (-) strand; PAM type: NNNNGHTT; PAM sequence: ACCTGATT
atagtctctcacttgttaag

SEQ ID NO: 26912 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
tgaatctgagcagtctggtt

SEQ ID NO: 26913 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
ggtggagttttattttgttg

SEQ ID NO: 26914 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
cacttggtggagttttattt

SEQ ID NO: 26915 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
aatttagtttagtcacttgg

SEQ ID NO: 26916 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
gaattgtatggatatttgaa

SEQ ID NO: 26917 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
attagctccttgagcggcac

SEQ ID NO: 26918 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
ggtgtgggtgagggcatcct

SEQ ID NO: 26919 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
tttaatggtgttgaattgag

SEQ ID NO: 26920 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
tttattttaatggtgttgaa

SEQ ID NO: 26921 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
aaggacaaagaaagtcaaga

SEQ ID NO: 26922 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
ggagaaaaggacaaagaaag

SEQ ID NO: 26923 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
ccagccctcatccactttga

SEQ ID NO: 26924 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
catttctaacatagtttggg

SEQ ID NO: 26925 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
tcccctttcttcatttctaa

SEQ ID NO: 26926 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
ttctactttgtagggttgtg

SEQ ID NO: 26927 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
tcgaggaagttcttttgagt

SEQ ID NO: 26928 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
atcatttcgaggaagttctt

SEQ ID NO: 26929 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
gatttaagaactagacaggc

SEQ ID NO: 26930 - DNA, 20 bp, Artificial Sequence
  Description of Artificial Sequence: Synthetic oligonucleotide
  Target: ATXN1; (-) strand; PAM type: NNNNGHTT; PAM sequence: CACGGATT
agcatggtatatgggaagaa

SEQ ID NO: 26931 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
ccttaaaaaaaaaacaaaaa

SEQ ID NO: 26932 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
ggtcaaactaagagtaagat

SEQ ID NO: 26933 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
actgttagacagactttcag

SEQ ID NO: 26934 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
tatttatttattcccccacc

SEQ ID NO: 26935 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
ttcagtcccagtatgggctc

SEQ ID NO: 26936 - DNA, 20 bp, Artificial Sequence
  Description of Artificial Sequence: Synthetic oligonucleotide
  Target: ATXN1; (-) strand; PAM type: NNNNGHTT; PAM sequence: TGCCGATT
tgctttcaggaggcccacat

SEQ ID NO: 26937 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
aaaaagtagtgattaacatg

SEQ ID NO: 26938 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
tgtcacaaagctcaaaaaag

SEQ ID NO: 26939 - DNA, 20 bp, Artificial Sequence
  Description of Artificial Sequence: Synthetic oligonucleotide
  Target: ATXN1; (-) strand; PAM type: NNNNGHTT; PAM sequence: ACAGGATT
aaagcccagaccaccaccac

SEQ ID NO: 26940 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
aaggaaattttgtcttcagg

SEQ ID NO: 26941 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
ttataggaatgtaaagtaac

SEQ ID NO: 26942 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
tccttactttccagctttga

SEQ ID NO: 26943 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
atgtttgattttccttactt

SEQ ID NO: 26944 - DNA, 20 bp, Artificial Sequence
  Description of Artificial Sequence: Synthetic oligonucleotide
  Target: ATXN1; (-) strand; PAM type: NNNNGHTT; PAM sequence: GTTTGATT
aaaaccccaagtagagcaat

SEQ ID NO: 26945 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
tttcaaaaccccaagtagag

SEQ ID NO: 26946 - DNA, 20 bp, Artificial Sequence
  Description of Artificial Sequence: Synthetic oligonucleotide
  Target: ATXN1; (-) strand; PAM type: NNNNGHTT; PAM sequence: GTTCGCTT
ccttgaggctatagaaagaa

SEQ ID NO: 26947 - DNA, 20 bp, Artificial Sequence
  Description of Artificial Sequence: Synthetic oligonucleotide
  Target: ATXN1; (-) strand; PAM type: NNNNGHTT; PAM sequence: GTGAGATT
taatataggtgagagctggc

SEQ ID NO: 26948 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
atcataccaaaatgggttgg

SEQ ID NO: 26949 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
tttatctttagctttcttat

SEQ ID NO: 26950 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
tatgcagaagctgttttatc

SEQ ID NO: 26951 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
ttagtgtttcattatgcaga

SEQ ID NO: 26952 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
gggcgtcacactctggggat

SEQ ID NO: 26953 - DNA, 20 bp, Artificial Sequence
  Description of Artificial Sequence: Synthetic oligonucleotide
  Target: ATXN1; (-) strand; PAM type: NNNNGHTT; PAM sequence: TGGGGATT
gtgtcgtgggcgtcacactc

SEQ ID NO: 26954 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
acaagtttgaactatgagaa

SEQ ID NO: 26955 - DNA, 20 bp, Artificial Sequence
  Description of Artificial Sequence: Synthetic oligonucleotide
  Target: ATXN1; (-) strand; PAM type: NNNNGHTT; PAM sequence: ACAAGTTT
aagctgatgaagcagtgagt

SEQ ID NO: 26956 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
ttttgcatgtgtgtttttaa

SEQ ID NO: 26957 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
gttgttgttcagttttgcat

SEQ ID NO: 26958 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gcgtttttttgttgttgttg

SEQ ID NO: 26959 - DNA, 20 bp, Artificial Sequence
  Description of Artificial Sequence: Synthetic oligonucleotide
  Target: ATXN1; (-) strand; PAM type: NNNNGHTT; PAM sequence: TAGCGTTT
tgaagaggctctactgggtt

SEQ ID NO: 26960 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
gcctgagtgaagaggctcta

SEQ ID NO: 26961 - DNA, 20 bp, Artificial Sequence
  Description of Artificial Sequence: Synthetic oligonucleotide
  Target: ATXN1; (-) strand; PAM type: NNNNGHTT; PAM sequence: GTCTGCTT
gtatattttcagtaagctgt

SEQ ID NO: 26962 - DNA, 20 bp, Artificial Sequence
  Description of Artificial Sequence: Synthetic oligonucleotide
  Target: ATXN1; (-) strand; PAM type: NNNNGHTT; PAM sequence: GGGTGCTT
ggtatcctagctaggaaagt

SEQ ID NO: 26963 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
aaacaaacaaaaaaaccact

SEQ ID NO: 26964 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
tatgcgaagccctatttccc

SEQ ID NO: 26965 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
cctttctctgctacttctgc

SEQ ID NO: 26966 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
tcccattaataaaagtggca

SEQ ID NO: 26967 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
tttgtttttgctataagtaa

SEQ ID NO: 26968 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
agaatgaatgaggtttgagc

SEQ ID NO: 26969 - DNA, 20 bp, Artificial Sequence
  Description of Artificial Sequence: Synthetic oligonucleotide
  Target: ATXN1; (-) strand; PAM type: NNNNGHTT; PAM sequence: TGAGGTTT
ccagataaccgcagaatgaa

SEQ ID NO: 26970 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
ccctccttctttttcctgtt

SEQ ID NO: 26971 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
aaatttcccctccttctttt

SEQ ID NO: 26972 - DNA, 20 bp, Artificial Sequence
  Description of Artificial Sequence: Synthetic oligonucleotide
  Target: ATXN1; (-) strand; PAM type: NNNNGHTT; PAM sequence: AAACGATT
cattctgaagggagggaaaa

SEQ ID NO: 26973 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
attaaacactttcctgacga

SEQ ID NO: 26974 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
ggtttttttttttttttttt

SEQ ID NO: 26975 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
aaatggatgatgaagaaagc

SEQ ID NO: 26976 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
agccaataaaatctctctaa

SEQ ID NO: 26977 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
gtgtgctccatggttatagc

SEQ ID NO: 26978 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
tattgtactttcttatattt

SEQ ID NO: 26979 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
cttagtacttttcatgcatt

SEQ ID NO: 26980 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
gaaacatctccctatgaaat

SEQ ID NO: 26981 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
ggtgtacgagcaagatgagt

SEQ ID NO: 26982 - DNA, 20 bp, Artificial Sequence
  Description of Artificial Sequence: Synthetic oligonucleotide
  Target: ATXN1; (-) strand; PAM type: NNNNGHTT; PAM sequence: AAACGTTT
ggatacagtgagattatttt

SEQ ID NO: 26983 - DNA, 20 bp, Artificial Sequence
  Description of Artificial Sequence: Synthetic oligonucleotide
  Target: ATXN1; (-) strand; PAM type: NNNNGHTT; PAM sequence: GTGAGATT
ggtcagaggtattggataca

SEQ ID NO: 26984 - DNA, 20 bp, Artificial Sequence
  Description of Artificial Sequence: Synthetic oligonucleotide
  Target: ATXN1; (-) strand; PAM type: NNNNGHTT; PAM sequence: ATGGGATT
aactaagcggtgaaaatgtg

SEQ ID NO: 26985 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
aatgatacacggtatggggt

SEQ ID NO: 26986 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
gtatgcaatgatacacggta

SEQ ID NO: 26987 - DNA, 20 bp, Artificial Sequence
  Description of Artificial Sequence: Synthetic oligonucleotide
  Target: ATXN1; (-) strand; PAM type: NNNNGHTT; PAM sequence: CCAGGATT
ggttaggtgcctgttgagcc

SEQ ID NO: 26988 - DNA, 20 bp, Artificial Sequence
  Description of Artificial Sequence: Synthetic oligonucleotide
  Target: ATXN1; (-) strand; PAM type: NNNNGHTT; PAM sequence: CTATGATT
cagttcaaggctgcagtgat

SEQ ID NO: 26989 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
tgacttgggaggctgaggca

SEQ ID NO: 26990 - DNA, 20 bp, Artificial Sequence
  Description of Artificial Sequence: Synthetic oligonucleotide
  Target: ATXN1; (-) strand; PAM type: NNNNGHTT; PAM sequence: GGTGGCTT
ttattgattgggcttggtgt

SEQ ID NO: 26991 - DNA, 20 bp, Artificial Sequence
  Description of Artificial Sequence: Synthetic oligonucleotide
  Target: ATXN1; (-) strand; PAM type: NNNNGHTT; PAM sequence: TTGGGCTT
aacttggaaattattattga

SEQ ID NO: 26992 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
agccataacttggaaattat

SEQ ID NO: 26993 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
catcaggaaagactttctta

SEQ ID NO: 26994 - DNA, 20 bp, Artificial Sequence
  Description of Artificial Sequence: Synthetic oligonucleotide
  Target: ATXN1; (-) strand; PAM type: NNNNGHTT; PAM sequence: CGGAGCTT
aatcgcttgaacctgggagg

SEQ ID NO: 26995 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
tcgggaggctgaggcaggac

SEQ ID NO: 26996 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
acagtgttcgtatgctgaga

SEQ ID NO: 26997 - DNA, 20 bp, Artificial Sequence
  Description of Artificial Sequence: Synthetic oligonucleotide
  Target: ATXN1; (-) strand; PAM type: NNNNGHTT; PAM sequence: CATGGATT
agccttctttggtacctggt

SEQ ID NO: 26998 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
tttactcatccattccttct

SEQ ID NO: 26999 - DNA, 20 bp, Artificial Sequence
  Description of Artificial Sequence: Synthetic oligonucleotide
  Target: ATXN1; (-) strand; PAM type: NNNNGHTT; PAM sequence: CGTTGATT
caacatgctttaccttcatt

SEQ ID NO: 27000 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
taatcaccctgtctcaaaca

SEQ ID NO: 27001 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
atatttacttttataatggg

SEQ ID NO: 27002 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
aaggagtttttgccaggagc

SEQ ID NO: 27003 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tccatttctgtacaaatgca

SEQ ID NO: 27004 - DNA, 20 bp, Artificial Sequence
  Description of Artificial Sequence: Synthetic oligonucleotide
  Target: ATXN1; (-) strand; PAM type: NNNNGHTT; PAM sequence: AACCGATT
tatcgcttaatgtggccaaa

SEQ ID NO: 27005 - DNA, 20 bp, Artificial Sequence
  Description of Artificial Sequence: Synthetic oligonucleotide
  Target: ATXN1; (-) strand; PAM type: NNNNGHTT; PAM sequence: TATCGCTT
gatgtgcttaaggaaagaag

SEQ ID NO: 27006 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
gaaagccacagagggagttg

SEQ ID NO: 27007 - DNA, 20 bp, Artificial Sequence
  Description of Artificial Sequence: Synthetic oligonucleotide
  Target: ATXN1; (-) strand; PAM type: NNNNGHTT; PAM sequence: AGTGGATT
tgtgccaggccatgtattcc

SEQ ID NO: 27008 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
tccctgcttctctattcctt

SEQ ID NO: 27009 - DNA, 20 bp, Artificial Sequence
  Description of Artificial Sequence: Synthetic oligonucleotide
  Target: ATXN1; (-) strand; PAM type: NNNNGHTT; PAM sequence: CCCTGCTT
gttcagatctcatgaatgct

SEQ ID NO: 27010 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
ttcagaccatgacatcaagc

SEQ ID NO: 27011 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
tattcaacagaaaaggaaat

SEQ ID NO: 27012 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
caggaggatcacttgagccc

SEQ ID NO: 27013 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
ggattggctattaattataa

SEQ ID NO: 27014 - DNA, 20 bp, Artificial Sequence
  Description of Artificial Sequence: Synthetic oligonucleotide
  Target: ATXN1; (-) strand; PAM type: NNNNGHTT; PAM sequence: ATAGGATT
gtgatagaactatcataaga

SEQ ID NO: 27015 - DNA, 20 bp, Artificial Sequence
  Description of Artificial Sequence: Synthetic oligonucleotide
  Target: ATXN1; (-) strand; PAM type: NNNNGHTT; PAM sequence: ATATGATT
atttataaaatacaaagagt

SEQ ID NO: 27016 - DNA, 20 bp, Artificial Sequence
  Description of Artificial Sequence: Synthetic oligonucleotide
  Target: ATXN1; (-) strand; PAM type: NNNNGHTT; PAM sequence: GGCTGATT
gcacctttgcttgttacgtt

SEQ ID NO: 27017 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
cctcaaggcctccctggcac

SEQ ID NO: 27018 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
tggttcatgtgtccttgtat

SEQ ID NO: 27019 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
tttctattcaaatcatttag

SEQ ID NO: 27020 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
tatggagaacagtggtgcta

SEQ ID NO: 27021 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
tacagacagtaaatgcattt

SEQ ID NO: 27022 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
attgttaaataaaaacacgc

SEQ ID NO: 27023 - DNA, 20 bp, Artificial Sequence
  Description of Artificial Sequence: Synthetic oligonucleotide
  Target: ATXN1; (-) strand; PAM type: NNNNGHTT; PAM sequence: ACCAGCTT
tgtgtagacatactcagaac

SEQ ID NO: 27024 - DNA, 20 bp, Artificial Sequence
  Description of Artificial Sequence: Synthetic oligonucleotide
  Target: ATXN1; (-) strand; PAM type: NNNNGHTT; PAM sequence: CCGAGTTT
taaatgtggattgttttgtt

SEQ ID NO: 27025 - DNA, 20 bp, Artificial Sequence
  Description of Artificial Sequence: Synthetic oligonucleotide
  Target: ATXN1; (-) strand; PAM type: NNNNGHTT; PAM sequence: GATTGTTT
tcagggtattactaaatgtg

SEQ ID NO: 27026 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
agcttcagggtattactaaa

SEQ ID NO: 27027 - DNA, 20 bp, Artificial Sequence
  Description of Artificial Sequence: Synthetic oligonucleotide
  Target: ATXN1; (-) strand; PAM type: NNNNGHTT; PAM sequence: GTCAGCTT
cacagtgaatacaaattaga

SEQ ID NO: 27028 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
tctcactttctaataattac

SEQ ID NO: 27029 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
cccagcttcccaaaagtaat

SEQ ID NO: 27030 - DNA, 20 bp, Artificial Sequence
  Description of Artificial Sequence: Synthetic oligonucleotide
  Target: ATXN1; (-) strand; PAM type: NNNNGHTT; PAM sequence: CCCAGCTT
cttagactataaagccatct

SEQ ID NO: 27031 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
gagagagagaatctgtaact

SEQ ID NO: 27032 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
tgttttcagttttgtctctt

SEQ ID NO: 27033 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
aattggattacgtacatgtt

SEQ ID NO: 27034 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
tatgcaaaattggattacgt

SEQ ID NO: 27035 - DNA, 20 bp, Artificial Sequence
  Description of Artificial Sequence: Synthetic oligonucleotide
  Target: ATXN1; (-) strand; PAM type: NNNNGHTT; PAM sequence: ATTGGATT
ccgcagagacattatgcaaa

SEQ ID NO: 27036 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
gagtgccagtacccagccag

SEQ ID NO: 27037 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
tgaattccagctgggcacct

SEQ ID NO: 27038 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
aaaacaggaaggccagaaac

SEQ ID NO: 27039 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gtttgatatgtggggttggt

SEQ ID NO: 27040 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
accacggtttgatatgtggg

SEQ ID NO: 27041 - DNA, 20 bp, Artificial Sequence
  Description of Artificial Sequence: Synthetic oligonucleotide
  Target: ATXN1; (-) strand; PAM type: NNNNGHTT; PAM sequence: CACGGTTT
taaagtgacgaaaatgacac

SEQ ID NO: 27042 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
aatgtaactgttagttcagt

SEQ ID NO: 27043 - DNA, 20 bp, Artificial Sequence
  Description of Artificial Sequence: Synthetic oligonucleotide
  Target: ATXN1; (-) strand; PAM type: NNNNGHTT; PAM sequence: CCATGCTT
taaaaggtctgaggaccttt

SEQ ID NO: 27044 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
ctacagccttttacattcaa

SEQ ID NO: 27045 - DNA, 20 bp, Artificial Sequence
  Description of Artificial Sequence: Synthetic oligonucleotide
  Target: ATXN1; (-) strand; PAM type: NNNNGHTT; PAM sequence: ACCTGCTT
cctcccgtgtgaaactctgc

SEQ ID NO: 27046 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
tggctaaactgcattgtatt

SEQ ID NO: 27047 - DNA, 20 bp, Artificial Sequence
  Description of Artificial Sequence: Synthetic oligonucleotide
  Target: ATXN1; (-) strand; PAM type: NNNNGHTT; PAM sequence: ATGGGCTT
gcatatgcagtggccatgaa

SEQ ID NO: 27048 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
ggctatctttgcaccaggtc

SEQ ID NO: 27049 - DNA, 20 bp, Artificial Sequence
  Description of Artificial Sequence: Synthetic oligonucleotide
  Target: ATXN1; (-) strand; PAM type: NNNNGHTT; PAM sequence: ATATGATT
ccaacttggaatgaagagga

SEQ ID NO: 27050 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
gagaaagtgcgcttactgtg

SEQ ID NO: 27051 - DNA, 20 bp, Artificial Sequence
  Description of Artificial Sequence: Synthetic oligonucleotide
  Target: ATXN1; (-) strand; PAM type: NNNNGHTT; PAM sequence: GTGCGCTT
ggatgtctggagaagagaaa

SEQ ID NO: 27052 - DNA, 20 bp, Artificial Sequence
  Description of Artificial Sequence: Synthetic oligonucleotide
  Target: ATXN1; (-) strand; PAM type: NNNNGHTT; PAM sequence: CAGGGCTT
attcactgaggcagaattgc

SEQ ID NO: 27053 - DNA, 20 bp, Artificial Sequence
  Description of Artificial Sequence: Synthetic oligonucleotide
  Target: ATXN1; (-) strand; PAM type: NNNNGHTT; PAM sequence: GTCGGATT
atttcactgtggaggtagaa

SEQ ID NO: 27054 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
tgctgcccctcaactagcta

SEQ ID NO: 27055 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
ggattccagttctcaggttg

SEQ ID NO: 27056 - DNA, 20 bp, Artificial Sequence
  Description of Artificial Sequence: Synthetic oligonucleotide
  Target: ATXN1; (-) strand; PAM type: NNNNGHTT; PAM sequence: GGTTGATT
tgggtggattccagttctca

SEQ ID NO: 27057 - DNA, 20 bp, Artificial Sequence
  Description of Artificial Sequence: Synthetic oligonucleotide
  Target: ATXN1; (-) strand; PAM type: NNNNGHTT; PAM sequence: GGTGGATT
aaaggcataggtgtgtcttg

SEQ ID NO: 27058 - DNA, 20 bp, Artificial Sequence
  Description of Artificial Sequence: Synthetic oligonucleotide
  Target: ATXN1; (-) strand; PAM type: NNNNGHTT; PAM sequence: GCAGGATT
tgaggaggctgttgtgaagg

SEQ ID NO: 27059 - DNA, 20 bp, Artificial Sequence
  Description of Artificial Sequence: Synthetic oligonucleotide
  Target: ATXN1; (-) strand; PAM type: NNNNGHTT; PAM sequence: TAGCGTTT
tgtcatgtatccattttttg

SEQ ID NO: 27060 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
agtagtaaacctttaagatt

SEQ ID NO: 27061 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
tgcttttcagtagtaaacct

SEQ ID NO: 27062 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
aaagcaccttactgaaaata

SEQ ID NO: 27063 - DNA, 20 bp, Artificial Sequence
  Description of Artificial Sequence: Synthetic oligonucleotide
  Target: ATXN1; (-) strand; PAM type: NNNNGHTT; PAM sequence: GTGTGATT
aaatgtattcagagagaggt

SEQ ID NO: 27064 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
taactgaacagagccagcac

SEQ ID NO: 27065 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
tgacagcatctcaattatgt

SEQ ID NO: 27066 - DNA, 20 bp, Artificial Sequence
  Description of Artificial Sequence: Synthetic oligonucleotide
  Target: ATXN1; (-) strand; PAM type: NNNNGHTT; PAM sequence: GACTGATT
ttcagggggcttggttggtt

SEQ ID NO: 27067 - DNA, 20 bp, Artificial Sequence
  Description of Artificial Sequence: Synthetic oligonucleotide
  Target: ATXN1; (-) strand; PAM type: NNNNGHTT; PAM sequence: GGGGGCTT
catcacaaggacccagttca

SEQ ID NO: 27068 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
atttaatttctgtccactca

SEQ ID NO: 27069 - DNA, 20 bp, Artificial Sequence
  Description of Artificial Sequence: Synthetic oligonucleotide
  Target: ATXN1; (-) strand; PAM type: NNNNGHTT; PAM sequence: ACTTGCTT
catgataccagcagcctcca

SEQ ID NO: 27070 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
taaatgatgcataaaaacac

SEQ ID NO: 27071 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
tagtccaatccataagtttc

SEQ ID NO: 27072 - DNA, 20 bp, Artificial Sequence
  Description of Artificial Sequence: Synthetic oligonucleotide
  Target: ATXN1; (-) strand; PAM type: NNNNGHTT; PAM sequence: TTTCGTTT
aggctagtccaatccataag

SEQ ID NO: 27073 - DNA, 20 bp, Artificial Sequence
  Description of Artificial Sequence: Synthetic oligonucleotide
  Target: ATXN1; (-) strand; PAM type: NNNNGHTT; PAM sequence: ATAAGTTT
tcgtaaggctagtccaatcc

SEQ ID NO: 27074 - DNA, 20 bp, Artificial Sequence
  Description of Artificial Sequence: Synthetic oligonucleotide
  Target: ATXN1; (-) strand; PAM type: NNNNGHTT; PAM sequence: ATAGGATT
acacctgttcttccagtctt

SEQ ID NO: 27075 - DNA, 20 bp, Artificial Sequence
  Description of Artificial Sequence: Synthetic oligonucleotide
  Target: ATXN1; (-) strand; PAM type: NNNNGHTT; PAM sequence: TCTTGATT
tcgtcccttgaacccgtagc

SEQ ID NO: 27076 - DNA, 20 bp, Artificial Sequence
  Description of Artificial Sequence: Synthetic oligonucleotide
  Target: ATXN1; (-) strand; PAM type: NNNNGHTT; PAM sequence: CCCGGCTT
cattcatgcgcatgcacaca

SEQ ID NO: 27077 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
gtaaatggctccaaatcacc

SEQ ID NO: 27078 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
cataggaaacctctcctctg

SEQ ID NO: 27079 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
gatactattattaaatagcc

SEQ ID NO: 27080 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
tggggcatgagctggtctgt

SEQ ID NO: 27081 - DNA, 20 bp, Artificial Sequence
  Description of Artificial Sequence: Synthetic oligonucleotide
  Target: ATXN1; (-) strand; PAM type: NNNNGHTT; PAM sequence: AGTTGATT
agacagcaatggagaattcc

SEQ ID NO: 27082 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
ccaggccagtgagctcttac

SEQ ID NO: 27083 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
cctttgcacctgaaacactt

SEQ ID NO: 27084 - DNA, 20 bp, Artificial Sequence
  Description of Artificial Sequence: Synthetic oligonucleotide
  Target: ATXN1; (-) strand; PAM type: NNNNGHTT; PAM sequence: CACTGCTT
agacgcaacaccaacagtga

SEQ ID NO: 27085 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
aggccatagctcaaatattg

SEQ ID NO: 27086 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
tatgaaagaactaagagatc

SEQ ID NO: 27087 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
tttgtaaatattaatttgtg

SEQ ID NO: 27088 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
ctggacctacagccagtctt

SEQ ID NO: 27089 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
aatacctgaagaatgattaa

SEQ ID NO: 27090 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
aggacaaagtaatacctgaa

SEQ ID NO: 27091 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
ttataaatgcgtctgaaatc

SEQ ID NO: 27092 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
agggacccagattacaactg

SEQ ID NO: 27093 - DNA, 20 bp, Artificial Sequence
  Description of Artificial Sequence: Synthetic oligonucleotide
  Target: ATXN1; (-) strand; PAM type: NNNNGHTT; PAM sequence: CCCAGATT
ctatactgaagctttaggga

SEQ ID NO: 27094 - DNA, 20 bp, Artificial Sequence
  Description of Artificial Sequence: Synthetic oligonucleotide
  Target: ATXN1; (-) strand; PAM type: NNNNGHTT; PAM sequence: TGAAGCTT
tacaagataaatgtctatac

SEQ ID NO: 27095 - DNA, 20 bp, Artificial Sequence
  Description of Artificial Sequence: Synthetic oligonucleotide
  Target: ATXN1; (-) strand; PAM type: NNNNGHTT; PAM sequence: CCGTGTTT
ggagggaaccaagccctgag

SEQ ID NO: 27096 - DNA, 20 bp, Artificial Sequence
  Description of Artificial Sequence: Synthetic oligonucleotide
  Target: ATXN1; (-) strand; PAM type: NNNNGHTT; PAM sequence: CCGTGTTT
cactgaccctgatattgcag

SEQ ID NO: 27097 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
tcatgcttatagggtgcaca

SEQ ID NO: 27098 - DNA, 20 bp, Artificial Sequence
  Description of Artificial Sequence: Synthetic oligonucleotide
  Target: ATXN1; (-) strand; PAM type: NNNNGHTT; PAM sequence: TCATGCTT
gaagtctaattctaatgtca

SEQ ID NO: 27099 - DNA, 20 bp, Artificial Sequence
  Description of Artificial Sequence: Synthetic oligonucleotide
  Target: ATXN1; (-) strand; PAM type: NNNNGHTT; PAM sequence: GCTAGCTT
cagtctgtgagcatcttgag

SEQ ID NO: 27100 - DNA, 20 bp, Artificial Sequence
  Description of Artificial Sequence: Synthetic oligonucleotide
  Target: ATXN1; (-) strand; PAM type: NNNNGHTT; PAM sequence: ATATGCTT
gctccagcctgtcttgtgcc

SEQ ID NO: 27101 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
ccttctgtcctcaaaaggtt

SEQ ID NO: 27102 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
aatattgccttctgtcctca

SEQ ID NO: 27103 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
ttctcattctcatttgcctg

SEQ ID NO: 27104 - DNA, 20 bp, Artificial Sequence
  Description of Artificial Sequence: Synthetic oligonucleotide
  Target: ATXN1; (-) strand; PAM type: NNNNGHTT; PAM sequence: GGTAGCTT
caacattttcctttggccag

SEQ ID NO: 27105 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
catctgcttgcagaagagct

SEQ ID NO: 27106 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
ctcctagagatttgtcatcc

SEQ ID NO: 27107 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
tgaacaacacagcctcctcc

SEQ ID NO: 27108 - DNA, 20 bp, Artificial Sequence
  Description of Artificial Sequence: Synthetic oligonucleotide
  Target: ATXN1; (-) strand; PAM type: NNNNGHTT; PAM sequence: TGGCGCTT
ctctgcttacatacatggct

SEQ ID NO: 27109 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
caggtggctctgcttacata

SEQ ID NO: 27110 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
accacacacaggccaggtgg

SEQ ID NO: 27111 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
agtgtcctggagttttcagc

SEQ ID NO: 27112 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
gctgcttggttaaagtgtcc

SEQ ID NO: 27113 - DNA, 20 bp, Artificial Sequence
  Description of Artificial Sequence: Synthetic oligonucleotide
  Target: ATXN1; (-) strand; PAM type: NNNNGHTT; PAM sequence: GGCTGCTT
gacagagatgtacaaatggg

SEQ ID NO: 27114 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
ctttttttttttttctttcc

SEQ ID NO: 27115 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
ttctgagcttggcctctgct

SEQ ID NO: 27116 - DNA, 20 bp, Artificial Sequence
  Description of Artificial Sequence: Synthetic oligonucleotide
  Target: ATXN1; (-) strand; PAM type: NNNNGHTT; PAM sequence: CTGAGCTT
gcggcattgaagggcttgtt

SEQ ID NO: 27117 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
gctttaggtgagcggcattg

SEQ ID NO: 27118 - DNA, 20 bp, Artificial Sequence
  Description of Artificial Sequence: Synthetic oligonucleotide
  Target: ATXN1; (-) strand; PAM type: NNNNGHTT; PAM sequence: CGGGGCTT
agactttattggtgaggggg

SEQ ID NO: 27119 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
taaccttaaaagaacaattc

SEQ ID NO: 27120 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
cagtgccaaggctgagaaac

SEQ ID NO: 27121 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
gtctgaatgtctgaagtcat

SEQ ID NO: 27122 - DNA, 20 bp, Artificial Sequence
  Description of Artificial Sequence: Synthetic oligonucleotide
  Target: ATXN1; (-) strand; PAM type: NNNNGHTT; PAM sequence: CCGTGATT
actctctataaaatttacct

SEQ ID NO: 27123 - DNA, 20 bp, Artificial Sequence
  Description of Artificial Sequence: Synthetic oligonucleotide
  Target: ATXN1; (-) strand; PAM type: NNNNGHTT; PAM sequence: AGTAGTTT
taaccttcatgcaataagag

SEQ ID NO: 27124 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
attttgtcattgtatcgtgt

SEQ ID NO: 27125 - DNA, 20 bp, Artificial Sequence
  Description of Artificial Sequence: Synthetic oligonucleotide
  Target: ATXN1; (-) strand; PAM type: NNNNGHTT; PAM sequence: TAGGGATT
aaacgaggaccactctgtct

SEQ ID NO: 27126 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
atctgcctgaaaacttccat

SEQ ID NO: 27127 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
aggcatgtgcctgtgtgcac

SEQ ID NO: 27128 - DNA, 20 bp, Artificial Sequence
  Description of Artificial Sequence: Synthetic oligonucleotide
  Target: ATXN1; (-) strand; PAM type: NNNNGHTT; PAM sequence: GTCTGCTT
attttcaatcatctttctgc

SEQ ID NO: 27129 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
atctgtgaggaatttttata

SEQ ID NO: 27130 - DNA, 20 bp, Artificial Sequence
  Description of Artificial Sequence: Synthetic oligonucleotide
  Target: ATXN1; (-) strand; PAM type: NNNNGHTT; PAM sequence: CCGAGATT
gagccagaggttgcagtgag

SEQ ID NO: 27131 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
caggtggatcgcctgaggtc

SEQ ID NO: 27132 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
ttatgttggtgcaaaagtaa

SEQ ID NO: 27133 - DNA, 20 bp, Artificial Sequence
  Description of Artificial Sequence: Synthetic oligonucleotide
  Target: ATXN1; (-) strand; PAM type: NNNNGHTT; PAM sequence: AAGCGCTT
tcaagctcttggaacagtgc

SEQ ID NO: 27134 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
ctcctttcctcatttgcaaa

SEQ ID NO: 27135 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
ggttcaaatctccctctggc

SEQ ID NO: 27136 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
cccattaacctctccccact

SEQ ID NO: 27137 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tctacagtcagtaaggaaaa

SEQ ID NO: 27138 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
actctgatgctattgctact

SEQ ID NO: 27139 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgggtggatcacctgaggcc

SEQ ID NO: 27140 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
ctaaaactcatagaaacaca

SEQ ID NO: 27141 - DNA, 20 bp, Artificial Sequence
  Description of Artificial Sequence: Synthetic oligonucleotide
  Target: ATXN1; (-) strand; PAM type: NNNNGHTT; PAM sequence: TGCGGTTT
agggaggtggtaatacctgc

SEQ ID NO: 27142 - DNA, 20 bp, Artificial Sequence
  Description of Artificial Sequence: Synthetic oligonucleotide
  Target: ATXN1; (-) strand; PAM type: NNNNGHTT; PAM sequence: CCCCGTTT
aactgcctgtgcctccatgc

SEQ ID NO: 27143 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
ccagctaggaatccacagac

SEQ ID NO: 27144 - DNA, 20 bp, Artificial Sequence
  Description of Artificial Sequence: Synthetic oligonucleotide
  Target: ATXN1; (-) strand; PAM type: NNNNGHTT; PAM sequence: GCAAGCTT
attgtgattttgcctgagtg

SEQ ID NO: 27145 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
cttacggattctgagtctta

SEQ ID NO: 27146 - DNA, 20 bp, Artificial Sequence
  Description of Artificial Sequence: Synthetic oligonucleotide
  Target: ATXN1; (-) strand; PAM type: NNNNGHTT; PAM sequence: TACGGATT
tccaggcaaatttagtcgct

SEQ ID NO: 27147 - DNA, 20 bp, Artificial Sequence
  Description of Artificial Sequence: Synthetic oligonucleotide
  Target: ATXN1; (-) strand; PAM type: NNNNGHTT; PAM sequence: AGTCGCTT
atgtcactccaggcaaattt

SEQ ID NO: 27148 - DNA, 20 bp, Artificial Sequence
  Description of Artificial Sequence: Synthetic oligonucleotide
  Target: ATXN1; (-) strand; PAM type: NNNNGHTT; PAM sequence: GGCCGTTT
tgccacttcacccctgatgt

SEQ ID NO: 27149 - DNA, 20 bp, Artificial Sequence
  Description of Artificial Sequence: Synthetic oligonucleotide
  Target: ATXN1; (-) strand; PAM type: NNNNGHTT; PAM sequence: GGGGGATT
gaagaccaaatcagagatgt

SEQ ID NO: 27150 - DNA, 20 bp, Artificial Sequence
  Description of Artificial Sequence: Synthetic oligonucleotide
  Target: ATXN1; (-) strand; PAM type: NNNNGHTT; PAM sequence: GTCAGCTT
gctaattactcataataact

SEQ ID NO: 27151 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
ttggtggtaaaaggcaaagc

SEQ ID NO: 27152 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
ttcccaaaaatggaagggga

SEQ ID NO: 27153 - DNA, 20 bp, Artificial Sequence
  Description of Artificial Sequence: Synthetic oligonucleotide
  Target: ATXN1; (-) strand; PAM type: NNNNGHTT; PAM sequence: GCAAGATT
agttagatgaaatatggttg

SEQ ID NO: 27154 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
aaatattcaaccctttttag

SEQ ID NO: 27155 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
tattctaaaaacctggtatg

SEQ ID NO: 27156 - DNA, 20 bp, Artificial Sequence
  Description of Artificial Sequence: Synthetic oligonucleotide
  Target: ATXN1; (-) strand; PAM type: NNNNGHTT; PAM sequence: GTATGCTT
ttctctattctaaaaacctg

SEQ ID NO: 27157 - DNA, 20 bp, Artificial Sequence
  Description of Artificial Sequence: Synthetic oligonucleotide
  Target: ATXN1; (-) strand; PAM type: NNNNGHTT; PAM sequence: TCGAGTTT
tccaggaataaaatctgcac

SEQ ID NO: 27158 - DNA, 20 bp, Artificial Sequence
  Description of Artificial Sequence: Synthetic oligonucleotide
  Target: ATXN1; (-) strand; PAM type: NNNNGHTT; PAM sequence: GGCAGCTT
ttttacttctgcaaaatcaa

SEQ ID NO: 27159 - DNA, 20 bp, Artificial Sequence
  Description of Artificial Sequence: Synthetic oligonucleotide
  Target: ATXN1; (-) strand; PAM type: NNNNGHTT; PAM sequence: TCGAGTTT
aaatgctttcaaaattatac

SEQ ID NO: 27160 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
tagatagcatcactattttg

SEQ ID NO: 27161 - DNA, 20 bp, Artificial Sequence
  Description of Artificial Sequence: Synthetic oligonucleotide
  Target: ATXN1; (-) strand; PAM type: NNNNGHTT; PAM sequence: CTTAGTTT
actctggcagttctccctgc

SEQ ID NO: 27162 - DNA, 20 bp, Artificial Sequence
  Description of Artificial Sequence: Synthetic oligonucleotide
  Target: ATXN1; (-) strand; PAM type: NNNNGHTT; PAM sequence: TCTGGATT
ggattttgatatcgtggaga

SEQ ID NO: 27163 - DNA, 20 bp, Artificial Sequence
  Description of Artificial Sequence: Synthetic oligonucleotide
  Target: ATXN1; (-) strand; PAM type: NNNNGHTT; PAM sequence: GAAGGATT
cacagttgcatagtggcgaa

SEQ ID NO: 27164 - DNA, 20 bp, Artificial Sequence
  Description of Artificial Sequence: Synthetic oligonucleotide
  Target: ATXN1; (-) strand; PAM type: NNNNGHTT; PAM sequence: GATAGTTT
tttaatacatcgtctgtatt

SEQ ID NO: 27165 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
tcagaaaagcaggctaagga

SEQ ID NO: 27166 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
atcactctctggataccctc

SEQ ID NO: 27167 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
ccatttggtatttcaaaata

SEQ ID NO: 27168 - DNA, 20 bp, Artificial Sequence
  Description of Artificial Sequence: Synthetic oligonucleotide
  Target: ATXN1; (-) strand; PAM type: NNNNGHTT; PAM sequence: ACAAGTTT
atgttgccaaagtaggttga

SEQ ID NO: 27169 - DNA, 20 bp, Artificial Sequence
  Description of Artificial Sequence: Synthetic oligonucleotide
  Target: ATXN1; (-) strand; PAM type: NNNNGHTT; PAM sequence: AATCGATT
caataaccagtgacagagga

SEQ ID NO: 27170 - DNA, 20 bp, Artificial Sequence
  Description of Artificial Sequence: Synthetic oligonucleotide
  Target: ATXN1; (-) strand; PAM type: NNNNGHTT; PAM sequence: TGCGGTTT
tgtaacattgtgattttcca

SEQ ID NO: 27171 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
tcaatttaacgagtgtaaca

SEQ ID NO: 27172 - DNA, 20 bp, Artificial Sequence
  Description of Artificial Sequence: Synthetic oligonucleotide
  Target: ATXN1; (-) strand; PAM type: NNNNGHTT; PAM sequence: CGTTGATT
cagagagatttgcatatcct

SEQ ID NO: 27173 - DNA, 20 bp, Artificial Sequence
  Description of Artificial Sequence: Synthetic oligonucleotide
  Target: ATXN1; (-) strand; PAM type: NNNNGHTT; PAM sequence: GAGAGATT
tgcaaatgagctatggaaca

SEQ ID NO: 27174 - DNA, 20 bp, Artificial Sequence
  Description of Artificial Sequence: Synthetic oligonucleotide
  Target: ATXN1; (-) strand; PAM type: NNNNGHTT; PAM sequence: ATAAGCTT
gtaaacatcacacacagcta

SEQ ID NO: 27175 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
ttaaatgttttaactattaa

SEQ ID NO: 27176 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
gcttttaaattatatagttt

SEQ ID NO: 27177 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
ccttgcatgcttttaaatta

SEQ ID NO: 27178 - DNA, 20 bp, Artificial Sequence
  Description of Artificial Sequence: Synthetic oligonucleotide
  Target: ATXN1; (-) strand; PAM type: NNNNGHTT; PAM sequence: GCATGCTT
tctttttttccctcttcctt

SEQ ID NO: 27179 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
ttaacagcacaaatatatct

SEQ ID NO: 27180 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
aggttaagcaaattttgtgg

SEQ ID NO: 27181 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
catagtttataagcaaatgt

SEQ ID NO: 27182 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
gtggctgggttcaagccctt

SEQ ID NO: 27183 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
cagacattggcaggcttcca

SEQ ID NO: 27184 - DNA, 20 bp, Artificial Sequence
  Description of Artificial Sequence: Synthetic oligonucleotide
  Target: ATXN1; (-) strand; PAM type: NNNNGHTT; PAM sequence: GCAGGCTT
gaatgtcagcccagacattg

SEQ ID NO: 27185 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
ttgaaatacatagaaacttg

SEQ ID NO: 27186 - DNA, 20 bp, Artificial Sequence
  Description of Artificial Sequence: Synthetic oligonucleotide
  Target: ATXN1; (-) strand; PAM type: NNNNGHTT; PAM sequence: GAGAGATT
agttttaaaacattagtttt

SEQ ID NO: 27187 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
aatatcaagagttttaaaac

SEQ ID NO: 27188 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
gtagtgcctcagaaaatatc

SEQ ID NO: 27189 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
attcactctgaactgagagg

SEQ ID NO: 27190 - DNA, 20 bp, Artificial Sequence
  Description of Artificial Sequence: Synthetic oligonucleotide
  Target: ATXN1; (-) strand; PAM type: NNNNGHTT; PAM sequence: CCCTGTTT
tcttcaaccttcttttctca

SEQ ID NO: 27191 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
ttaaatatttatagattttt

SEQ ID NO: 27192 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
gtaactaatatttaaatatt

SEQ ID NO: 27193 - DNA, 20 bp, Artificial Sequence
  Description of Artificial Sequence: Synthetic oligonucleotide
  Target: ATXN1; (-) strand; PAM type: NNNNGHTT; PAM sequence: CTATGCTT
cacatgaaatgcaaaagatt

SEQ ID NO: 27194 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
tcagatgccacatgaaatgc

SEQ ID NO: 27195 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
aatttaatttaatgttgaac

SEQ ID NO: 27196 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
ctttgcttgtaggggcaggt

SEQ ID NO: 27197 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
taaccaggagggacatctct

SEQ ID NO: 27198 - DNA, 20 bp, Artificial Sequence
  Description of Artificial Sequence: Synthetic oligonucleotide
  Target: ATXN1; (-) strand; PAM type: NNNNGHTT; PAM sequence: GGGTGCTT
ctgggctgcacgtgacaaag

SEQ ID NO: 27199 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
acggcattaaaactttcaaa

SEQ ID NO: 27200 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
agctgaattccatcaagaca

SEQ ID NO: 27201 - DNA, 20 bp, Artificial Sequence
  Description of Artificial Sequence: Synthetic oligonucleotide
  Target: ATXN1; (-) strand; PAM type: NNNNGHTT; PAM sequence: ACCTGTTT
ctgtttcatgcacttaatgc

SEQ ID NO: 27202 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
gagcacttttcttacttttg

SEQ ID NO: 27203 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
ccaggtctgcagactgtcac

SEQ ID NO: 27204 - DNA, 20 bp, Artificial Sequence
  Description of Artificial Sequence: Synthetic oligonucleotide
  Target: ATXN1; (-) strand; PAM type: NNNNGHTT; PAM sequence: CCTCGTTT
gttagaggacgcgtcgtgac

SEQ ID NO: 27205 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
atgtttgctgagtgcttgtt

SEQ ID NO: 27206 - DNA, 20 bp, Artificial Sequence
  Description of Artificial Sequence: Synthetic oligonucleotide
  Target: ATXN1; (-) strand; PAM type: NNNNGHTT; PAM sequence: GAGTGCTT
gtttggcatccatgtttgct

SEQ ID NO: 27207 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
atgagataatagtttggcat

SEQ ID NO: 27208 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
ggcacattgaattatgagat

SEQ ID NO: 27209 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
ttggggttttacttgtttca

SEQ ID NO: 27210 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
tcaaattaatttggggtttt

SEQ ID NO: 27211 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
catatggtgtcaaattaatt

SEQ ID NO: 27212 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
tattataaatgccaatttcc

SEQ ID NO: 27213 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
gggtctgttttgatgtgtgc

SEQ ID NO: 27214 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
gataattaagacttaactgg

SEQ ID NO: 27215 - DNA, 20 bp, Artificial Sequence
  Description of Artificial Sequence: Synthetic oligonucleotide
  Target: ATXN1; (-) strand; PAM type: NNNNGHTT; PAM sequence: GATTGATT
agtgaagaaggaaaggggtt

SEQ ID NO: 27216 - DNA, 20 bp, Artificial Sequence
  Description of Artificial Sequence: Synthetic oligonucleotide
  Target: ATXN1; (-) strand; PAM type: NNNNGHTT; PAM sequence: GGTTGATT
ttacagtgaagaaggaaagg

SEQ ID NO: 27217 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
catttcccaataacacagat

SEQ ID NO: 27218 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
gaacatttccattcagtaag

SEQ ID NO: 27219 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
atagcagattctccatcagt

SEQ ID NO: 27220 - DNA, 20 bp, Artificial Sequence
  Description of Artificial Sequence: Synthetic oligonucleotide
  Target: ATXN1; (-) strand; PAM type: NNNNGHTT; PAM sequence: AGCAGATT
cagcacagtgcctggtgtat

SEQ ID NO: 27221 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
cactatgagagcagggagct

SEQ ID NO: 27222 - DNA, 20 bp, Artificial Sequence
  Description of Artificial Sequence: Synthetic oligonucleotide
  Target: ATXN1; (-) strand; PAM type: NNNNGHTT; PAM sequence: GGGAGCTT
taagaagcactatgagagca

SEQ ID NO: 27223 - DNA, 20 bp, Artificial Sequence
  Description of Artificial Sequence: Synthetic oligonucleotide
  Target: ATXN1; (-) strand; PAM type: NNNNGHTT; PAM sequence: ATGTGATT
acatataaaaataggtattt

SEQ ID NO: 27224 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
tctaggagccacagcttctc

SEQ ID NO: 27225 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
cctaccttctttctaggagc

SEQ ID NO: 27226 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
tggatccatgactcctgcat

SEQ ID NO: 27227 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
atggcttagtctctagacca

SEQ ID NO: 27228 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
ctctaagtgttggagttcct

SEQ ID NO: 27229 - DNA, 20 bp, Artificial Sequence
  Description of Artificial Sequence: Synthetic oligonucleotide
  Target: ATXN1; (-) strand; PAM type: NNNNGHTT; PAM sequence: ACCTGCTT
tcttcaggtgttccctttct

SEQ ID NO: 27230 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
ctgtctaaataccttcctcc

SEQ ID NO: 27231 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
agttctcatctcactttctc

SEQ ID NO: 27232 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
cccatgtcattggaccagtt

SEQ ID NO: 27233 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
cctgtctcctgcttggtcat

SEQ ID NO: 27234 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
ccctgcggtccacccctgtc

SEQ ID NO: 27235 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
gaggacattccttagctggc

SEQ ID NO: 27236 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
tggcccgaggacattcctta

SEQ ID NO: 27237 - DNA, 20 bp, Artificial Sequence
  Description of Artificial Sequence: Synthetic oligonucleotide
  Target: ATXN1; (-) strand; PAM type: NNNNGHTT; PAM sequence: ACTTGCTT
agccctagagaaataaagta

SEQ ID NO: 27238 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tagtaggtgagcactgttac

SEQ ID NO: 27239 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
gaggtggagattgcagtgag

SEQ ID NO: 27240 - DNA, 20 bp, Artificial Sequence
  Description of Artificial Sequence: Synthetic oligonucleotide
  Target: ATXN1; (-) strand; PAM type: NNNNGHTT; PAM sequence: TGGAGATT
aatagctggaacccgggagg

SEQ ID NO: 27241 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
caggcagatcacctgaggtc

SEQ ID NO: 27242 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
atgagtcagccactgggcta

SEQ ID NO: 27243 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
gcagatggatgctcaataaa

SEQ ID NO: 27244 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
accaccaccctagccccctt

SEQ ID NO: 27245 - DNA, 20 bp, Artificial Sequence
  Description of Artificial Sequence: Synthetic oligonucleotide
  Target: ATXN1; (-) strand; PAM type: NNNNGHTT; PAM sequence: ACAAGCTT
tgtgaggtcttttttgactg

SEQ ID NO: 27246 - DNA, 20 bp, Artificial Sequence
  Description of Artificial Sequence: Synthetic oligonucleotide
  Target: ATXN1; (-) strand; PAM type: NNNNGHTT; PAM sequence: TCAGGCTT
tgctttctatttccctttct

SEQ ID NO: 27247 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
ggctcttcccccagtcacca

SEQ ID NO: 27248 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
agtaacctcctgagtagtct

SEQ ID NO: 27249 - DNA, 20 bp, Artificial Sequence
  Description of Artificial Sequence: Synthetic oligonucleotide
  Target: ATXN1; (-) strand; PAM type: NNNNGHTT; PAM sequence: ACCTGCTT
actcttgatattctacccca

SEQ ID NO: 27250 - DNA, 20 bp, Artificial Sequence
  Description of Artificial Sequence: Synthetic oligonucleotide
  Target: ATXN1; (-) strand; PAM type: NNNNGHTT; PAM sequence: TCAGGCTT
ctgggccttttctttgaacc

SEQ ID NO: 27251 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
gggctcagtcctcaaacctg

SEQ ID NO: 27252 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
agtagcggaaagtagcagcc

SEQ ID NO: 27253 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
catgtagacatgtgtagctt

SEQ ID NO: 27254 - DNA, 20 bp, Artificial Sequence
  Description of Artificial Sequence: Synthetic oligonucleotide
  Target: ATXN1; (-) strand; PAM type: NNNNGHTT; PAM sequence: TGTAGCTT
gcccttcccatgtagacatg

SEQ ID NO: 27255 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
catggccctgccttctgact

SEQ ID NO: 27256 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
aattcccagccacctctggc

SEQ ID NO: 27257 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
acacaaggagcttggattat

SEQ ID NO: 27258 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
gcaggaagagacacaaggag

SEQ ID NO: 27259 - DNA, 20 bp, Artificial Sequence
  Description of Artificial Sequence: Synthetic oligonucleotide
  Target: ATXN1; (-) strand; PAM type: NNNNGHTT; PAM sequence: AGGAGCTT
ttaaagcaggaagagacaca

SEQ ID NO: 27260 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
tctccttacactctctgcta

SEQ ID NO: 27261 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
cacatctttctattgcatga

SEQ ID NO: 27262 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
agcctcatggaccagtgcca

SEQ ID NO: 27263 - DNA, 20 bp, Artificial Sequence
  Description of Artificial Sequence: Synthetic oligonucleotide
  Target: ATXN1; (-) strand; PAM type: NNNNGHTT; PAM sequence: ATTAGATT
cctgtcagatcagtggcagc

SEQ ID NO: 27264 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
cagagtccattgttatcttt

SEQ ID NO: 27265 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
cctattatgtgttgtaatat

SEQ ID NO: 27266 - DNA, 20 bp, Artificial Sequence
  Description of Artificial Sequence: Synthetic oligonucleotide
  Target: ATXN1; (-) strand; PAM type: NNNNGHTT; PAM sequence: GATGGATT
aatttactgtctacaaggga

SEQ ID NO: 27267 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
tacagaaagacaatatcttg

SEQ ID NO: 27268 - DNA, 20 bp, Artificial Sequence
  Description of Artificial Sequence: Synthetic oligonucleotide
  Target: ATXN1; (-) strand; PAM type: NNNNGHTT; PAM sequence: ATCTGATT
aaacagtaagtggaccagtt

SEQ ID NO: 27269 - DNA, 20 bp, Artificial Sequence
  Description of Artificial Sequence: Synthetic oligonucleotide
  Target: ATXN1; (-) strand; PAM type: NNNNGHTT; PAM sequence: GCTGGATT
attattctgagatcctcctg

SEQ ID NO: 27270 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
atttttcattctgttatttt

SEQ ID NO: 27271 - DNA, 20 bp, Artificial Sequence
  Description of Artificial Sequence: Synthetic oligonucleotide
  Target: ATXN1; (-) strand; PAM type: NNNNGHTT; PAM sequence: CGGGGCTT
acctcccgtgtactggctga

SEQ ID NO: 27272 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
gattccagaatagcaacttg

SEQ ID NO: 27273 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
acttgattcccatcttacac

SEQ ID NO: 27274 - DNA, 20 bp, Artificial Sequence
  Description of Artificial Sequence: Synthetic oligonucleotide
  Target: ATXN1; (-) strand; PAM type: NNNNGHTT; PAM sequence: ACTTGATT
tctattaatgactctgttag

SEQ ID NO: 27275 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
actttggagtttcctctttt

SEQ ID NO: 27276 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
cagtaatgaaagggtaactt

SEQ ID NO: 27277 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
acaaagggccttgtttcctg

SEQ ID NO: 27278 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
tagcaccttttgacaaaggg

SEQ ID NO: 27279 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
acgtgcttcttatagtgtag

SEQ ID NO: 27280 - DNA, 20 bp, Artificial Sequence
  Description of Artificial Sequence: Synthetic oligonucleotide
  Target: ATXN1; (-) strand; PAM type: NNNNGHTT; PAM sequence: ACGTGCTT
atggaacacaggatgggcaa

SEQ ID NO: 27281 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
agtaatactataaaggaact

SEQ ID NO: 27282 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
attgacatcacatttttctt

SEQ ID NO: 27283 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
agaagtctctagctctgaaa

SEQ ID NO: 27284 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
agacacaatttagatcaagt

SEQ ID NO: 27285 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
atcaaaagacacaatttaga

SEQ ID NO: 27286 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
caaaacaagctcaatttttt

SEQ ID NO: 27287 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
ttagggacaagaaaactaca

SEQ ID NO: 27288 - DNA, 20 bp, Artificial Sequence
  Description of Artificial Sequence: Synthetic oligonucleotide
  Target: ATXN1; (-) strand; PAM type: NNNNGHTT; PAM sequence: CACAGATT
atgaaaagtttgatttcggt

SEQ ID NO: 27289 - DNA, 20 bp, Artificial Sequence
  Description of Artificial Sequence: Synthetic oligonucleotide
  Target: ATXN1; (-) strand; PAM type: NNNNGHTT; PAM sequence: GTTTGATT
caaatacttcaaaatgaaaa

SEQ ID NO: 27290 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
acctcaaatacttcaaaatg

SEQ ID NO: 27291 - DNA, 20 bp, Artificial Sequence
  Description of Artificial Sequence: Synthetic oligonucleotide
  Target: ATXN1; (-) strand; PAM type: NNNNGHTT; PAM sequence: TCTGGATT
tttctgctaaatactatgcc

SEQ ID NO: 27292 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
ttttttaatagtgcttgaga

SEQ ID NO: 27293 - DNA, 20 bp, Artificial Sequence
  Description of Artificial Sequence: Synthetic oligonucleotide
  Target: ATXN1; (-) strand; PAM type: NNNNGHTT; PAM sequence: TAGTGCTT
gccccactttaattttttaa

SEQ ID NO: 27294 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
acttcagcctcccaaaagtg

SEQ ID NO: 27295 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttggtaaaga

SEQ ID NO: 27296 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccgagtag

SEQ ID NO: 27297 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctccgcctcccgggttc

SEQ ID NO: 27298 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
catttagacctcccaaagtg

SEQ ID NO: 27299 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttggtagaga

SEQ ID NO: 27300 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
tttgaaatatcaaagttttc

SEQ ID NO: 27301 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
ttttagctcttttgaaatat

SEQ ID NO: 27302 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
ttcatttctgaatgttttta

SEQ ID NO: 27303 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
tctccaatcacttcatttct

SEQ ID NO: 27304 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
ttgcctctctctatccaact

SEQ ID NO: 27305 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
tatttggtcttcatctagaa

SEQ ID NO: 27306 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
ttttttaagacagggtctca

SEQ ID NO: 27307 - DNA, 20 bp, Artificial Sequence
  Description of Artificial Sequence: Synthetic oligonucleotide
  Target: ATXN1; (-) strand; PAM type: NNNNGHTT; PAM sequence: TCCCGCTT
tgccatcatcttccctgaat

SEQ ID NO: 27308 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
actggcagggaggaggaggg

SEQ ID NO: 27309 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
tggctgtgtaattccaattt

SEQ ID NO: 27310 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
attttgtcttgatgtggtcc

SEQ ID NO: 27311 - DNA, 20 bp, Artificial Sequence
  Description of Artificial Sequence: Synthetic oligonucleotide
  Target: ATXN1; (-) strand; PAM type: NNNNGHTT; PAM sequence: TCAGGTTT
ggccacacccattcctgtct

SEQ ID NO: 27312 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
ccaactttctcttgcacaga

SEQ ID NO: 27313 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
accgtgccgtaaggaccttt

SEQ ID NO: 27314 - DNA, 20 bp, Artificial Sequence
  Description of Artificial Sequence: Synthetic oligonucleotide
  Target: ATXN1; (-) strand; PAM type: NNNNGHTT; PAM sequence: ATTGGATT
tccttgccctcaccccatga

SEQ ID NO: 27315 - DNA, 20 bp, Artificial Sequence
  Description of Artificial Sequence: Synthetic oligonucleotide
  Target: ATXN1; (-) strand; PAM type: NNNNGHTT; PAM sequence: CTTAGATT
gatttggtcgtggaaggaag

SEQ ID NO: 27316 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
aaggtgatttggtcgtggaa

SEQ ID NO: 27317 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
ctctcaaaagtttcttctca

SEQ ID NO: 27318 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
tcgatttagattctgctctc

SEQ ID NO: 27319 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
attattactgccatgttcga

SEQ ID NO: 27320 - DNA, 20 bp, Artificial Sequence
  Description of Artificial Sequence: Synthetic oligonucleotide
  Target: ATXN1; (-) strand; PAM type: NNNNGHTT; PAM sequence: GTTCGATT
ggctaaattattactgccat

SEQ ID NO: 27321 - DNA, 20 bp, Artificial Sequence
  Description of Artificial Sequence: Synthetic oligonucleotide
  Target: ATXN1; (-) strand; PAM type: NNNNGHTT; PAM sequence: CTTAGCTT
taaaataaggcctatatttt

SEQ ID NO: 27322 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
ggccatagaactccgtcttc

SEQ ID NO: 27323 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
gttactcatttttaagtgga

SEQ ID NO: 27324 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
tctctgtggtaagaatgcta

SEQ ID NO: 27325 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
tttgaaatattaaagttttc

SEQ ID NO: 27326 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
ttttagctcttttgaaatat

SEQ ID NO: 27327 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
ttcatttctgaatgttttta

SEQ ID NO: 27328 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
tctccaatcacttcatttct

SEQ ID NO: 27329 - DNA, 20 bp, Artificial Sequence
  Description of Artificial Sequence: Synthetic oligonucleotide
  Target: ATXN1; (-) strand; PAM type: NNNNGHTT; PAM sequence: TTTCGTTT
ctagaaaatggattttcttt

SEQ ID NO: 27330 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
tatttggtcttcatctagaa

SEQ ID NO: 27331 - DNA, 20 bp, Artificial Sequence
  Description of Artificial Sequence: Synthetic oligonucleotide
  Target: ATXN1; (-) strand; PAM type: NNNNGHTT; PAM sequence: CAAAGATT
ttctattttttagcactcct

SEQ ID NO: 27332 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
tttctttcctcatttctttt

SEQ ID NO: 27333 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
gctcttattacagtgttatg

SEQ ID NO: 27334 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
ttttaagcatttgctgtttt

SEQ ID NO: 27335 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
cagtcacgattttaagcatt

SEQ ID NO: 27336 - DNA, 20 bp, Artificial Sequence
  Description of Artificial Sequence: Synthetic oligonucleotide
  Target: ATXN1; (-) strand; PAM type: NNNNGHTT; PAM sequence: TCACGATT
ttctagaatttgtgcttcag

SEQ ID NO: 27337 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
tctttttctacttctagaat

SEQ ID NO: 27338 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
catggagtattctgtcaata

SEQ ID NO: 27339 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
ttttttgttttctttcctag

SEQ ID NO: 27340 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tgagtgtccaaagaattttt

SEQ ID NO: 27341 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
ttttggctgggtataagatc

SEQ ID NO: 27342 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
ttgggtccttgcatattcat

SEQ ID NO: 27343 - DNA, 20 bp, Artificial Sequence
  Description of Artificial Sequence: Synthetic oligonucleotide
  Target: ATXN1; (-) strand; PAM type: NNNNGHTT; PAM sequence: AAGGGTTT
cttctcccttgcagattact

SEQ ID NO: 27344 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
gttgcctgactcttctccct

SEQ ID NO: 27345 - DNA, 20 bp, Artificial Sequence
  Description of Artificial Sequence: Synthetic oligonucleotide
  Target: ATXN1; (-) strand; PAM type: NNNNGHTT; PAM sequence: AGCTGATT
tctttcagtaacagacctac

SEQ ID NO: 27346 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
atcgttctggctatatgtaa

SEQ ID NO: 27347 - DNA, 20 bp, Artificial Sequence
  Description of Artificial Sequence: Synthetic oligonucleotide
  Target: ATXN1; (-) strand; PAM type: NNNNGHTT; PAM sequence: GCGTGTTT
gttcctttcatattcttccc

SEQ ID NO: 27348 - DNA, 20 bp, Artificial Sequence
  Description of Artificial Sequence: Synthetic oligonucleotide
  Target: ATXN1; (-) strand; PAM type: NNNNGHTT; PAM sequence: GTGAGATT
cccacttaacatctatgtta

SEQ ID NO: 27349 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
tattttcttctctggctata

SEQ ID NO: 27350 - DNA, 20 bp, Artificial Sequence
  Description of Artificial Sequence: Synthetic oligonucleotide
  Target: ATXN1; (-) strand; PAM type: NNNNGHTT; PAM sequence: GAGTGATT
gtttattggtttccaactct

SEQ ID NO: 27351 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
acttttcttagctgttgttt

SEQ ID NO: 27352 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
tcccccaaacttttcttagc

SEQ ID NO: 27353 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
catgcccagccttccagtaa

SEQ ID NO: 27354 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
cgccttggcctcccaaagtg

SEQ ID NO: 27355 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttggatttttggtagaga

SEQ ID NO: 27356 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
gccaccacgaccaggtaatt

SEQ ID NO: 27357 - DNA, 20 bp, Artificial Sequence
  Description of Artificial Sequence: Synthetic oligonucleotide
  Target: ATXN1; (-) strand; PAM type: NNNNGHTT; PAM sequence: ATGGGATT
tgcctcagcctcctgagtag

SEQ ID NO: 27358 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
ctcactgcagcctcaccctc

SEQ ID NO: 27359 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gcccgctattttttttgttt

SEQ ID NO: 27360 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
ccatgcccgctatttttttt

SEQ ID NO: 27361 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cccaccatgcccgctatttt

SEQ ID NO: 27362 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
ctcactgcagccttgaactc

SEQ ID NO: 27363 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
tttttttttttttttgctcc

SEQ ID NO: 27364 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
taagcaatcatactatttag

SEQ ID NO: 27365 - DNA, 20 bp, Artificial Sequence
  Description of Artificial Sequence: Synthetic oligonucleotide
  Target: ATXN1; (-) strand; PAM type: NNNNGHTT; PAM sequence: GTCTGCTT
gaagtctgtctttcatgcct

SEQ ID NO: 27366 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
cttcctaagaggcttttgaa

SEQ ID NO: 27367 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
ctttaatttgagacttccta

SEQ ID NO: 27368 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
atttggaatagttacagtct

SEQ ID NO: 27369 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
ttttgattgtttagttttgt

SEQ ID NO: 27370 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
ggttttttttattttgattg

SEQ ID NO: 27371 - DNA, 20 bp, Artificial Sequence
  Description of Artificial Sequence: Synthetic oligonucleotide
  Target: ATXN1; (-) strand; PAM type: NNNNGHTT; PAM sequence: GATTGTTT
tttaaggttttttttatttt

SEQ ID NO: 27372 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
aatgtttaaggtttttttta

SEQ ID NO: 27373 - DNA, 20 bp, Artificial Sequence
  Description of Artificial Sequence: Synthetic oligonucleotide
  Target: ATXN1; (-) strand; PAM type: NNNNGHTT; PAM sequence: TAAGGTTT
atatgcttactgaaaatgtt

SEQ ID NO: 27374 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
tgcaacaatatgcttactga

SEQ ID NO: 27375 - DNA, 20 bp, Artificial Sequence
  Description of Artificial Sequence: Synthetic oligonucleotide
  Target: ATXN1; (-) strand; PAM type: NNNNGHTT; PAM sequence: ATATGCTT
atgccagtgacattgcaaca

SEQ ID NO: 27376 - DNA, 20 bp, Artificial Sequence
  Description of Artificial Sequence: Synthetic oligonucleotide
  Target: ATXN1; (-) strand; PAM type: NNNNGHTT; PAM sequence: CAAGGCTT
gagtttatactgatgtgcca

SEQ ID NO: 27377 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
tttttaaggtaaaatacctc

SEQ ID NO: 27378 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
ctccttggcctcccaaagtg

SEQ ID NO: 27379 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttctgtttttagtagaga

SEQ ID NO: 27380 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
caccacgcctggctaatctt

SEQ ID NO: 27381 - DNA, 20 bp, Artificial Sequence
  Description of Artificial Sequence: Synthetic oligonucleotide
  Target: ATXN1; (-) strand; PAM type: NNNNGHTT; PAM sequence: GATCGATT
tctctctagatatagatata

SEQ ID NO: 27382 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
actgttctcactgggttgaa

SEQ ID NO: 27383 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
tcagcttttttccaaggaga

SEQ ID NO: 27384 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
tttcttgccttagctctggg

SEQ ID NO: 27385 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
ctggctgtctttgatagttt

SEQ ID NO: 27386 - DNA, 20 bp, Artificial Sequence
  Description of Artificial Sequence: Synthetic oligonucleotide
  Target: ATXN1; (-) strand; PAM type: NNNNGHTT; PAM sequence: GATAGTTT
atccaatactggctgtcttt

SEQ ID NO: 27387 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gtctgagcattgggatccta

SEQ ID NO: 27388 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
tgttgtgtttcagtccatga

SEQ ID NO: 27389 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
catagattgcagcatatctg

SEQ ID NO: 27390 - DNA, 20 bp, Artificial Sequence
  Description of Artificial Sequence: Synthetic oligonucleotide
  Target: ATXN1; (-) strand; PAM type: NNNNGHTT; PAM sequence: CATAGATT
tgaaagcatgactgtaaatt

SEQ ID NO: 27391 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
cacagtgtcaaaccaagtca

SEQ ID NO: 27392 - DNA, 20 bp, Artificial Sequence
  Description of Artificial Sequence: Synthetic oligonucleotide
  Target: ATXN1; (-) strand; PAM type: NNNNGHTT; PAM sequence: ACTAGATT
taggaaaagcaggataatat

SEQ ID NO: 27393 - DNA, 20 bp, Artificial Sequence
  Description of Artificial Sequence: Synthetic oligonucleotide
  Target: ATXN1; (-) strand; PAM type: NNNNGHTT; PAM sequence: TCAGGTTT
taatttatctacccggtgct

SEQ ID NO: 27394 - DNA, 20 bp, Artificial Sequence
  Description of Artificial Sequence: Synthetic oligonucleotide
  Target: ATXN1; (-) strand; PAM type: NNNNGHTT; PAM sequence: CGGTGCTT
gcatctgtaatttatctacc

SEQ ID NO: 27395 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
atctgaattcataaatttat

SEQ ID NO: 27396 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
ttgtttgctttgctttgcct

SEQ ID NO: 27397 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
tagaggcattgttttgtttg

SEQ ID NO: 27398 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
agttctagaggcattgtttt

SEQ ID NO: 27399 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
aggaagttctagaggcattg

SEQ ID NO: 27400 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
ttgctaggaagttctagagg

SEQ ID NO: 27401 - DNA, 20 bp, Artificial Sequence
  Description of Artificial Sequence: Synthetic oligonucleotide
  Target: ATXN1; (-) strand; PAM type: NNNNGHTT; PAM sequence: GGATGATT
tttcccacccgtctgggttt

SEQ ID NO: 27402 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
tggtagaatttcccacccgt

SEQ ID NO: 27403 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
cctatgtcttttttttattt

SEQ ID NO: 27404 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
tttatgttgtaggatttttt

SEQ ID NO: 27405 - DNA, 20 bp, Artificial Sequence
  Description of Artificial Sequence: Synthetic oligonucleotide
  Target: ATXN1; (-) strand; PAM type: NNNNGHTT; PAM sequence: GTAGGATT
aataagttttattttatgtt

SEQ ID NO: 27406 - DNA, 20 bp, Artificial Sequence
  Description of Artificial Sequence: Synthetic oligonucleotide
  Target: ATXN1; (-) strand; PAM type: NNNNGHTT; PAM sequence: ATAAGTTT
ttttcctaattgacttatta

SEQ ID NO: 27407 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
tttactatttctataaatga

SEQ ID NO: 27408 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
aaatattttactatttctat

SEQ ID NO: 27409 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
cctggaccttgcatcttcat

SEQ ID NO: 27410 - DNA, 20 bp, Artificial Sequence
  Description of Artificial Sequence: Synthetic oligonucleotide
  Target: ATXN1; (-) strand; PAM type: NNNNGHTT; PAM sequence: CCTGGATT
ttctctactccacctctgca

SEQ ID NO: 27411 - DNA, 20 bp, Artificial Sequence
  Description of Artificial Sequence: Synthetic oligonucleotide
  Target: ATXN1; (-) strand; PAM type: NNNNGHTT; PAM sequence: CATCGTTT
ccattcagcagcagagccaa

SEQ ID NO: 27412 - DNA, 20 bp, Artificial Sequence
  Description of Artificial Sequence: Synthetic oligonucleotide
  Target: ATXN1; (-) strand; PAM type: NNNNGHTT; PAM sequence: GAACGCTT
aaagcagagaggtggtaaat

SEQ ID NO: 27413 - DNA, 20 bp, Artificial Sequence
  Description of Artificial Sequence: Synthetic oligonucleotide
  Target: ATXN1; (-) strand; PAM type: NNNNGHTT; PAM sequence: ACTGGATT
caaatgtccaacaatgatag

SEQ ID NO: 27414 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
caataaagacacatgcacat

SEQ ID NO: 27415 - DNA, 20 bp, Artificial Sequence
  Description of Artificial Sequence: Synthetic oligonucleotide
  Target: ATXN1; (-) strand; PAM type: NNNNGHTT; PAM sequence: TGGCGATT
aaccattgtggaagtcagtg

SEQ ID NO: 27416 - DNA, 20 bp, Artificial Sequence
  Description of Artificial Sequence: Synthetic oligonucleotide
  Target: ATXN1; (-) strand; PAM type: NNNNGHTT; PAM sequence: GGCAGCTT
gattcacaaatctggggttg

SEQ ID NO: 27417 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
ctgggcttcactcccaggaa

SEQ ID NO: 27418 - DNA, 20 bp, Artificial Sequence
  Description of Artificial Sequence: Synthetic oligonucleotide
  Target: ATXN1; (-) strand; PAM type: NNNNGHTT; PAM sequence: CTGGGCTT
tgtatgtaaaatacagtttt

SEQ ID NO: 27419 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
cctgcatactgtatgtaaaa

SEQ ID NO: 27420 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
tcctttaatagaaaaaaaac

SEQ ID NO: 27421 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
tgttactctaggctatttcc

SEQ ID NO: 27422 - DNA, 20 bp, Artificial Sequence
  Description of Artificial Sequence: Synthetic oligonucleotide
  Target: ATXN1; (-) strand; PAM type: NNNNGHTT; PAM sequence: TGTAGCTT
ccatacaaaaggcacatttc

SEQ ID NO: 27423 - DNA, 20 bp, Artificial Sequence
  Description of Artificial Sequence: Synthetic oligonucleotide
  Target: ATXN1; (-) strand; PAM type: NNNNGHTT; PAM sequence: TAGTGCTT
gacacattctttttggaaaa

SEQ ID NO: 27424 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
actgagtcattcaacaagcc

SEQ ID NO: 27425 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
cctttgctattgatgtctgt

SEQ ID NO: 27426 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
aaaatacctttgctattgat

SEQ ID NO: 27427 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
tcaggaggctgaggcaggag

SEQ ID NO: 27428 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
caggtggatcacttgaggcc

SEQ ID NO: 27429 - DNA, 20 bp, Artificial Sequence
  Description of Artificial Sequence: Synthetic oligonucleotide
  Target: ATXN1; (-) strand; PAM type: NNNNGHTT; PAM sequence: GTGCGATT
aaaccagcctgggcaacata

SEQ ID NO: 27430 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
gagtgtaactagcattttag

SEQ ID NO: 27431 - DNA, 20 bp, Artificial Sequence
  Description of Artificial Sequence: Synthetic oligonucleotide
  Target: ATXN1; (-) strand; PAM type: NNNNGHTT; PAM sequence: TAAAGCTT
attaaattagaaatcctata

SEQ ID NO: 27432 - DNA, 20 bp, Artificial Sequence
  Description of Artificial Sequence: Synthetic oligonucleotide
  Target: ATXN1; (-) strand; PAM type: NNNNGHTT; PAM sequence: TAAAGATT
ttaaaagctacaagcttcaa

SEQ ID NO: 27433 - DNA, 20 bp, Artificial Sequence
  Description of Artificial Sequence: Synthetic oligonucleotide
  Target: ATXN1; (-) strand; PAM type: NNNNGHTT; PAM sequence: ACAAGCTT
tttaaataagtttaaaagct

SEQ ID NO: 27434 - DNA, 20 bp, Artificial Sequence
  Description of Artificial Sequence: Synthetic oligonucleotide
  Target: ATXN1; (-) strand; PAM type: NNNNGHTT; PAM sequence: ATAAGTTT
agaatctttggggcttttaa

SEQ ID NO: 27435 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
aagcccgttggtagaatctt

SEQ ID NO: 27436 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
attctactatatggcacatg

SEQ ID NO: 27437 - DNA, 20 bp, Artificial Sequence
  Description of Artificial Sequence: Synthetic oligonucleotide
  Target: ATXN1; (-) strand; PAM type: NNNNGHTT; PAM sequence: ATCTGATT
ttgagtggaatggtattagg

SEQ ID NO: 27438 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
aaatgtaataggaagcattg

SEQ ID NO: 27439 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
gtcttgacatggaccaggac

SEQ ID NO: 27440 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
tgggcaggaaaaaagaggag

SEQ ID NO: 27441 - DNA, 20 bp, Artificial Sequence
  Description of Artificial Sequence: Synthetic oligonucleotide
  Target: ATXN1; (-) strand; PAM type: NNNNGHTT; PAM sequence: CCAGGATT
gaggagcattctaggtagga

SEQ ID NO: 27442 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
ttaaatagaaggagtaagtt

SEQ ID NO: 27443 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
aatacagttaaatagaagga

SEQ ID NO: 27444 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
gtgctaagactcataggtgc

SEQ ID NO: 27445 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
cttgggccttagcctagctc

SEQ ID NO: 27446 - DNA, 20 bp, Artificial Sequence
  Description of Artificial Sequence: Synthetic oligonucleotide
  Target: ATXN1; (-) strand; PAM type: NNNNGHTT; PAM sequence: GTAGGCTT
cgtccagacacagatctgat

SEQ ID NO: 27447 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
aaaacccttcatgcaagcaa

SEQ ID NO: 27448 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
aatgccaggatggaagttac

SEQ ID NO: 27449 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
cgtagggagaacttaagttt

SEQ ID NO: 27450 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
caagtggacgtagggagaac

SEQ ID NO: 27451 - DNA, 20 bp, Artificial Sequence
  Description of Artificial Sequence: Synthetic oligonucleotide
  Target: ATXN1; (-) strand; PAM type: NNNNGHTT; PAM sequence: GGGTGTTT
tcactgaggacaagaactca

SEQ ID NO: 27452 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
ttattacaccattttatact

SEQ ID NO: 27453 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
accataagcatggtatgtct

SEQ ID NO: 27454 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
tggtgggtccaatcttgaac

SEQ ID NO: 27455 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
ttttagaaggaagaaattgt

SEQ ID NO: 27456 - DNA, 20 bp, Artificial Sequence
  Description of Artificial Sequence: Synthetic oligonucleotide
  Target: ATXN1; (-) strand; PAM type: NNNNGHTT; PAM sequence: GATAGCTT
ctgcgatttggaggaccaat

SEQ ID NO: 27457 - DNA, 20 bp, Artificial Sequence
  Description of Artificial Sequence: Synthetic oligonucleotide
  Target: ATXN1; (-) strand; PAM type: NNNNGHTT; PAM sequence: CTGCGATT
acattttttaattggtaagc

SEQ ID NO: 27458 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
aaaacaaaaggaagaaaaga

SEQ ID NO: 27459 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
agttaccttgcaagctcagg

SEQ ID NO: 27460 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
aggagttgcaaataataatg

SEQ ID NO: 27461 - DNA, 20 bp, Artificial Sequence
  Description of Artificial Sequence: Synthetic oligonucleotide
  Target: ATXN1; (-) strand; PAM type: NNNNGHTT; PAM sequence: CCCTGATT
gttgtgcagtattgagaaaa

SEQ ID NO: 27462 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
cagctgcaatcttctttaac

SEQ ID NO: 27463 - DNA, 20 bp, Artificial Sequence
  Description of Artificial Sequence: Synthetic oligonucleotide
  Target: ATXN1; (-) strand; PAM type: NNNNGHTT; PAM sequence: TGAAGCTT
aaatcaagaagaaagaacaa

SEQ ID NO: 27464 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
attttgttagcataatgtat

SEQ ID NO: 27465 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
atcattcattgcctttactt

SEQ ID NO: 27466 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
aaggaccggtttttgtaaac

SEQ ID NO: 27467 - DNA, 20 bp, Artificial Sequence
  Description of Artificial Sequence: Synthetic oligonucleotide
  Target: ATXN1; (-) strand; PAM type: NNNNGHTT; PAM sequence: ACCGGTTT
ggagcatagttcccacaagg

SEQ ID NO: 27468 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
ttcatatattacttatatct

SEQ ID NO: 27469 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
caaacatgtgaaaaagaaga

SEQ ID NO: 27470 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
atgttgcatcagtgattgtt

SEQ ID NO: 27471 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
tgtgtaaacacatgttgcat

SEQ ID NO: 27472 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
actctgctaataataaacgt

SEQ ID NO: 27473 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
cattgaatacttcatatgga

SEQ ID NO: 27474 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
ggtcctttcccaagattgga

SEQ ID NO: 27475 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
ttcacctagaaggtcctttc

SEQ ID NO: 27476 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
tttctgagaggacctctcca

SEQ ID NO: 27477 - DNA, 20 bp, Artificial Sequence
  Description of Artificial Sequence: Synthetic oligonucleotide
  Target: ATXN1; (-) strand; PAM type: NNNNGHTT; PAM sequence: TCATGATT
atcctggagaaccgaatgat

SEQ ID NO: 27478 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
aaggagcatcctggagaacc

SEQ ID NO: 27479 - DNA, 20 bp, Artificial Sequence
  Description of Artificial Sequence: Synthetic oligonucleotide
  Target: ATXN1; (-) strand; PAM type: NNNNGHTT; PAM sequence: TTCGGTTT
aatgcttagaaaagattgac

SEQ ID NO: 27480 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
tgtccccatttaatgcttag

SEQ ID NO: 27481 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
gaagagaagatgtccccatt

SEQ ID NO: 27482 - DNA, 20 bp, Artificial Sequence
  Description of Artificial Sequence: Synthetic oligonucleotide
  Target: ATXN1; (-) strand; PAM type: NNNNGHTT; PAM sequence: GCTTGCTT
gtacagctgaagtggcaact

SEQ ID NO: 27483 - DNA, 20 bp, Artificial Sequence
  Description of Artificial Sequence: Synthetic oligonucleotide
  Target: ATXN1; (-) strand; PAM type: NNNNGHTT; PAM sequence: AACTGCTT
atttgtacagctgaagtggc

SEQ ID NO: 27484 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cacctgggcatcccaaagtt

SEQ ID NO: 27485 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
acagtgtttcactgtgttgg

SEQ ID NO: 27486 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
ttttgtatttttagtagaga

SEQ ID NO: 27487 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aaactctggccctcgggttc

SEQ ID NO: 27488 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
ggccttggcctcccaaagtg

SEQ ID NO: 27489 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagccttctgagtag

SEQ ID NO: 27490 - DNA, 20 bp, Artificial Sequence
  Description of Artificial Sequence: Synthetic oligonucleotide
  Target: ATXN1; (-) strand; PAM type: NNNNGHTT; PAM sequence: CGGAGTTT
ttctttttttttttttgaga

SEQ ID NO: 27491 - DNA, 20 bp, Artificial Sequence
  Description of Artificial Sequence: Synthetic oligonucleotide
  Target: ATXN1; (-) strand; PAM type: NNNNGHTT; PAM sequence: CCACGTTT
gagaactctaattacaaact

SEQ ID NO: 27492 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
tttttgtgaaatttgtttct

SEQ ID NO: 27493 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
cttgtttttgtgaaatttgt

SEQ ID NO: 27494 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
aaacaacttgtttttgtgaa

SEQ ID NO: 27495 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
ggatagcaaccttttaaaca

SEQ ID NO: 27496 - DNA, 20 bp, Artificial Sequence
  Description of Artificial Sequence: Synthetic oligonucleotide
  Target: ATXN1; (-) strand; PAM type: NNNNGHTT; PAM sequence: TGTCGTTT
tctctgtggatgtcattgaa

SEQ ID NO: 27497 - DNA, 20 bp, Artificial Sequence
  Description of Artificial Sequence: Synthetic oligonucleotide
  Target: ATXN1; (-) strand; PAM type: NNNNGHTT; PAM sequence: TCGTGTTT
ggtgctcagttgaccaaaca

SEQ ID NO: 27498 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
atgctatcaacaaaatctgg

SEQ ID NO: 27499 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
actcagagatggataatcct

SEQ ID NO: 27500 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
ctggctttttaaaagaaaaa

SEQ ID NO: 27501 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
ttttcagaaatgactgtccc

SEQ ID NO: 27502 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
actctggttttgattcacaa

SEQ ID NO: 27503 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
agtcacttggtctactctgg

SEQ ID NO: 27504 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
tgctcagtcacttggtctac

SEQ ID NO: 27505 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
gggaaaaaaatcagccatat

SEQ ID NO: 27506 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
aacaagagggatatgaagag

SEQ ID NO: 27507 - DNA, 20 bp, Artificial Sequence
  Description of Artificial Sequence: Synthetic oligonucleotide
  Target: ATXN1; (-) strand; PAM type: NNNNGHTT; PAM sequence: TAGAGTTT
ttgaacttttaaatcagtaa

SEQ ID NO: 27508 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
aaaaaatctagtcagctaaa

SEQ ID NO: 27509 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
tggtgataaagtaagtttaa

SEQ ID NO: 27510 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
atgcaaatgatggtgataaa

SEQ ID NO: 27511 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
caccaaaaacagaccttgaa

SEQ ID NO: 27512 - DNA, 20 bp, Artificial Sequence
  Description of Artificial Sequence: Synthetic oligonucleotide
  Target: ATXN1; (-) strand; PAM type: NNNNGHTT; PAM sequence: GTAAGATT
gagaaaagtaacatgattat

SEQ ID NO: 27513 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
gactgatgctgagaaaagta

SEQ ID NO: 27514 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttgtatttttagtagaga

SEQ ID NO: 27515 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctctgcctcccgggttc

SEQ ID NO: 27516 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
cagagcaattcttagacaat

SEQ ID NO: 27517 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
ctttcttaccctctttcatt

SEQ ID NO: 27518 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
tcattttccagaattagaaa

SEQ ID NO: 27519 - DNA, 20 bp, Artificial Sequence
  Description of Artificial Sequence: Synthetic oligonucleotide
  Target: ATXN1; (-) strand; PAM type: NNNNGHTT; PAM sequence: CTTCGATT
gtgtgagccatctcgcccag

SEQ ID NO: 27520 - DNA, 20 bp, Artificial Sequence
  Description of Artificial Sequence: Synthetic oligonucleotide
  Target: ATXN1; (-) strand; PAM type: NNNNGHTT; PAM sequence: CCCAGCTT
tacaagtgtgagccatctcg

SEQ ID NO: 27521 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgactcagcctcccaaagtg

SEQ ID NO: 27522 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttgtagttttagtagaga

SEQ ID NO: 27523 - DNA, 20 bp, Artificial Sequence
  Description of Artificial Sequence: Synthetic oligonucleotide
  Target: ATXN1; (-) strand; PAM type: NNNNGHTT; PAM sequence: TGTAGTTT
catgcctggctaaccttttt

SEQ ID NO: 27524 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctccacttcctgggttc

SEQ ID NO: 27525 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
aatatttatcgatctaattc

SEQ ID NO: 27526 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
cctggtcagctctctgatgg

SEQ ID NO: 27527 - DNA, 20 bp, Artificial Sequence
  Description of Artificial Sequence: Synthetic oligonucleotide
  Target: ATXN1; (-) strand; PAM type: NNNNGHTT; PAM sequence: CAATGATT
acaatatggagtggggaaaa

SEQ ID NO: 27528 - DNA, 20 bp, Artificial Sequence
  Description of Artificial Sequence: Synthetic oligonucleotide
  Target: ATXN1; (-) strand; PAM type: NNNNGHTT; PAM sequence: TATGGATT
gggctacaggtatatccaag

SEQ ID NO: 27529 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
tagataatgcagcttctcaa

SEQ ID NO: 27530 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
attggctacactgtagataa

SEQ ID NO: 27531 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
ttttgtctgctgactacaaa

SEQ ID NO: 27532 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
aaaaatgtttctgatggctg

SEQ ID NO: 27533 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
attttaaaaatgtttctgat

SEQ ID NO: 27534 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
aatttaatagcatattttaa

SEQ ID NO: 27535 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
tggttcttttgcattaattt

SEQ ID NO: 27536 - DNA, 20 bp, Artificial Sequence
  Description of Artificial Sequence: Synthetic oligonucleotide
  Target: ATXN1; (-) strand; PAM type: NNNNGHTT; PAM sequence: ATAAGATT
tttctgaatctgaactggtg

SEQ ID NO: 27537 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
taatatccaagctcccagat

SEQ ID NO: 27538 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
tctacctctttttatatcca

SEQ ID NO: 27539 - DNA, 20 bp, Artificial Sequence
  Description of Artificial Sequence: Synthetic oligonucleotide
  Target: ATXN1; (-) strand; PAM type: NNNNGHTT; PAM sequence: GTGAGCTT
actgctgagtccccctgaag

SEQ ID NO: 27540 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
ttcccaacccaatgcctgcc

SEQ ID NO: 27541 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
aagatgagtcttactacctg

SEQ ID NO: 27542 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
ggttgtttgttttctaatag

SEQ ID NO: 27543 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tccattttaaaaactgggtt

SEQ ID NO: 27544 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
tttgtccattttaaaaactg

SEQ ID NO: 27545 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
ataatgtggagcatcttttt

SEQ ID NO: 27546 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
tgttttaattcacagttccc

SEQ ID NO: 27547 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tttcataggtggtatcttgt

SEQ ID NO: 27548 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
ccattttcataggtggtatc

SEQ ID NO: 27549 - DNA, 20 bp, Artificial Sequence
  Description of Artificial Sequence: Synthetic oligonucleotide
  Target: ATXN1; (-) strand; PAM type: NNNNGHTT; PAM sequence: GTTGGATT
gcatctgctgttggcagtgt

SEQ ID NO: 27550 - DNA, 20 bp, Artificial Sequence
  Description of Artificial Sequence: Synthetic oligonucleotide
  Target: ATXN1; (-) strand; PAM type: NNNNGHTT; PAM sequence: AGTAGCTT
actgccaaactgttttccca

SEQ ID NO: 27551 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
agctttgtaggaaactgcca

SEQ ID NO: 27552 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
cattgcatgttaagagtatg

SEQ ID NO: 27553 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
tgccacattgcatgttaaga

SEQ ID NO: 27554 - DNA, 20 bp, Artificial Sequence
  Description of Artificial Sequence: Synthetic oligonucleotide
  Target: ATXN1; (-) strand; PAM type: NNNNGHTT; PAM sequence: GCATGCTT
atttgtgtagataccaagga

SEQ ID NO: 27555 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
tttttgtgtggacttaagtt

SEQ ID NO: 27556 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
gtgcaggtttttgtgtggac

SEQ ID NO: 27557 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
gctgctataaacatttgagt

SEQ ID NO: 27558 - DNA, 20 bp, Artificial Sequence
  Description of Artificial Sequence: Synthetic oligonucleotide
  Target: ATXN1; (-) strand; PAM type: NNNNGHTT; PAM sequence: TCACGATT
accacagttcatgtacccat

SEQ ID NO: 27559 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tttttatggcctgaaagctt

SEQ ID NO: 27560 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
acctctcatttttatggcct

SEQ ID NO: 27561 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
cactcaacccaggaagtcca

SEQ ID NO: 27562 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
gacaggaaagttcctgattg

SEQ ID NO: 27563 - DNA, 20 bp, Artificial Sequence
  Description of Artificial Sequence: Synthetic oligonucleotide
  Target: ATXN1; (-) strand; PAM type: NNNNGHTT; PAM sequence: TCCTGATT
ctcttataagacaggaaagt

SEQ ID NO: 27564 - DNA, 20 bp, Artificial Sequence
  Description of Artificial Sequence: Synthetic oligonucleotide
  Target: ATXN1; (-) strand; PAM type: NNNNGHTT; PAM sequence: GTGCGCTT
attttaccaagtgctgattg

SEQ ID NO: 27565 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
gattggtgcattttaccaag

SEQ ID NO: 27566 - DNA, 20 bp, Artificial Sequence
  Description of Artificial Sequence: Synthetic oligonucleotide
  Target: ATXN1; (-) strand; PAM type: NNNNGHTT; PAM sequence: CGTTGATT
gattggtgcattttacagag

SEQ ID NO: 27567 - DNA, 20 bp, Artificial Sequence
  Description of Artificial Sequence: Synthetic oligonucleotide
  Target: ATXN1; (-) strand; PAM type: NNNNGHTT; PAM sequence: CGTTGATT
gattggtgcattttacagag

SEQ ID NO: 27568 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
attggctacttttatactcc

SEQ ID NO: 27569 - DNA, 20 bp, Artificial Sequence
  Description of Artificial Sequence: Synthetic oligonucleotide
  Target: ATXN1; (-) strand; PAM type: NNNNGHTT; PAM sequence: CTGCGATT
gccatttttttcaatcctcc

SEQ ID NO: 27570 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
cttatttgtcccctcccata

SEQ ID NO: 27571 - DNA, 20 bp, Artificial Sequence
  Description of Artificial Sequence: Synthetic oligonucleotide
  Target: ATXN1; (-) strand; PAM type: NNNNGHTT; PAM sequence: GCCCGCTT
tgccactgctggctggggtg

SEQ ID NO: 27572 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
aactgtgaagagcgacagga

SEQ ID NO: 27573 - DNA, 20 bp, Artificial Sequence
  Description of Artificial Sequence: Synthetic oligonucleotide
  Target: ATXN1; (-) strand; PAM type: NNNNGHTT; PAM sequence: GGTGGATT
gtccagagttggttccagcc

SEQ ID NO: 27574 - DNA, 20 bp, Artificial Sequence
  Description of Artificial Sequence: Synthetic oligonucleotide
  Target: ATXN1; (-) strand; PAM type: NNNNGHTT; PAM sequence: CCTAGTTT
ttttaactggctgacaggtg

SEQ ID NO: 27575 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
cttagtcctgtggccatgct

SEQ ID NO: 27576 - DNA, 20 bp, Artificial Sequence
  Description of Artificial Sequence: Synthetic oligonucleotide
  Target: ATXN1; (-) strand; PAM type: NNNNGHTT; PAM sequence: CTAGGCTT
ggctttcctctctgtcgacc

SEQ ID NO: 27577 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
ttgttgagaccccggagctg

SEQ ID NO: 27578 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
agataggatagatgggtgag

SEQ ID NO: 27579 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
cttggagaagagaggcggga

SEQ ID NO: 27580 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
gaagagcaccagggacaggg

SEQ ID NO: 27581 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
tttggacaaaaattatgtct

SEQ ID NO: 27582 - DNA, 20 bp, Artificial Sequence
  Description of Artificial Sequence: Synthetic oligonucleotide
  Target: ATXN1; (-) strand; PAM type: NNNNGHTT; PAM sequence: CAGGGCTT
ttccagatagtcccccacaa

SEQ ID NO: 27583 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
atttctgagtctcctcctat

SEQ ID NO: 27584 - DNA, 20 bp, Artificial Sequence
  Description of Artificial Sequence: Synthetic oligonucleotide
  Target: ATXN1; (-) strand; PAM type: NNNNGHTT; PAM sequence: ATGCGTTT
tctccagggttggaagagtg

SEQ ID NO: 27585 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
tgaaaacctgttagagtcct

SEQ ID NO: 27586 - DNA, 20 bp, Artificial Sequence
  Description of Artificial Sequence: Synthetic oligonucleotide
  Target: ATXN1; (-) strand; PAM type: NNNNGHTT; PAM sequence: GTCAGATT
cacaaagaggactgagaaaa

SEQ ID NO: 27587 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
cagatttagtggcccttacc

SEQ ID NO: 27588 - DNA, 20 bp, Artificial Sequence
  Description of Artificial Sequence: Synthetic oligonucleotide
  Target: ATXN1; (-) strand; PAM type: NNNNGHTT; PAM sequence: GTCAGATT
cacaaaaaggactgaggaag

SEQ ID NO: 27589 - DNA, 20 bp, Artificial Sequence
  Description of Artificial Sequence: Synthetic oligonucleotide
  Target: ATXN1; (-) strand; PAM type: NNNNGHTT; PAM sequence: ACTAGTTT
accaaagcagcagcggaaac

SEQ ID NO: 27590 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
atctgaaagaaaaaaccgcc

SEQ ID NO: 27591 - DNA, 20 bp, Artificial Sequence
  Description of Artificial Sequence: Synthetic oligonucleotide
  Target: ATXN1; (-) strand; PAM type: NNNNGHTT; PAM sequence: GGGTGTTT
gggtgagcttgttgatgcct

SEQ ID NO: 27592 - DNA, 20 bp, Artificial Sequence
  Description of Artificial Sequence: Synthetic oligonucleotide
  Target: ATXN1; (-) strand; PAM type: NNNNGHTT; PAM sequence: GTGAGCTT
gcttaggatgcgtttcaagg

SEQ ID NO: 27593 - DNA, 20 bp, Artificial Sequence
  Description of Artificial Sequence: Synthetic oligonucleotide
  Target: ATXN1; (-) strand; PAM type: NNNNGHTT; PAM sequence: ATGCGTTT
attggtcccaatggcttagg

SEQ ID NO: 27594 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
ttgcgggacaaattggtccc

SEQ ID NO: 27595 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
aaaataagccgcttcttttt

SEQ ID NO: 27596 - DNA, 20 bp, Artificial Sequence
  Description of Artificial Sequence: Synthetic oligonucleotide
  Target: ATXN1; (-) strand; PAM type: NNNNGHTT; PAM sequence: AGCCGCTT
accgtagtgcagaaaaaata

SEQ ID NO: 27597 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
ggattatccttcagtaaaaa

SEQ ID NO: 27598 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
aatcgccagctttgcatagt

SEQ ID NO: 27599 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
cctcctgtggaatgtaaatc

SEQ ID NO: 27600 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
gcttgtttccttctggatgg

SEQ ID NO: 27601 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
ggtcctttggaaatttcttt

SEQ ID NO: 27602 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
tggtggtcctttggaaattt

SEQ ID NO: 27603 - DNA, 20 bp, Artificial Sequence
  Description of Artificial Sequence: Synthetic oligonucleotide
  Target: ATXN1; (-) strand; PAM type: NNNNGHTT; PAM sequence: AGGGGTTT
gagacataactgatagcctg

SEQ ID NO: 27604 - DNA, 20 bp, Artificial Sequence
  Description of Artificial Sequence: Synthetic oligonucleotide
  Target: ATXN1; (-) strand; PAM type: NNNNGHTT; PAM sequence: TACAGCTT
gggccaaattcccctccccc

SEQ ID NO: 27605 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
actttcccaggtctaccttg

SEQ ID NO: 27606 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
acatctctccaagtgaggtc

SEQ ID NO: 27607 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
gcattcttttcattaaaggc

SEQ ID NO: 27608 - DNA, 20 bp, Artificial Sequence
  Description of Artificial Sequence: Synthetic oligonucleotide
  Target: ATXN1; (-) strand; PAM type: NNNNGHTT; PAM sequence: GATGGCTT
cagtggggatccataatggg

SEQ ID NO: 27609 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
cttctggaatacaggtcaac

SEQ ID NO: 27610 - DNA, 20 bp, Artificial Sequence
  Description of Artificial Sequence: Synthetic oligonucleotide
  Target: ATXN1; (-) strand; PAM type: NNNNGHTT; PAM sequence: ATGGGCTT
tggacatcattgaataattc

SEQ ID NO: 27611 - DNA, 20 bp, Artificial Sequence
  Description of Artificial Sequence: Synthetic oligonucleotide
  Target: ATXN1; (-) strand; PAM type: NNNNGHTT; PAM sequence: GTAGGATT
atagctgcttgaggaaggca

SEQ ID NO: 27612 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
attttcttaaggcctcccat

SEQ ID NO: 27613 - DNA, 20 bp, Artificial Sequence
  Description of Artificial Sequence: Synthetic oligonucleotide
  Target: ATXN1; (-) strand; PAM type: NNNNGHTT; PAM sequence: AGCTGATT
gagctttctcctgatatctc

SEQ ID NO: 27614 - DNA, 20 bp, Artificial Sequence
  Description of Artificial Sequence: Synthetic oligonucleotide
  Target: ATXN1; (-) strand; PAM type: NNNNGHTT; PAM sequence: TGGAGCTT
cagggccaagggctcgcttt

SEQ ID NO: 27615 - DNA, 20 bp, Artificial Sequence
  Description of Artificial Sequence: Synthetic oligonucleotide
  Target: ATXN1; (-) strand; PAM type: NNNNGHTT; PAM sequence: GCTCGCTT
gattttgttcagggccaagg

SEQ ID NO: 27616 - DNA, 20 bp, Artificial Sequence
  Description of Artificial Sequence: Synthetic oligonucleotide
  Target: ATXN1; (-) strand; PAM type: NNNNGHTT; PAM sequence: TCCAGATT
ttgccaggtttaataatgcc

SEQ ID NO: 27617 - DNA, 20 bp, Artificial Sequence
  Description of Artificial Sequence: Synthetic oligonucleotide
  Target: ATXN1; (-) strand; PAM type: NNNNGHTT; PAM sequence: CCAGGTTT
attagagaacaccgcggttg

SEQ ID NO: 27618 - DNA, 20 bp, Artificial Sequence
  Description of Artificial Sequence: Synthetic oligonucleotide
  Target: ATXN1; (-) strand; PAM type: NNNNGHTT; PAM sequence: TCTCGCTT
aggctgcggcctttctctta

SEQ ID NO: 27619 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gtcctctctgaaccaccaag

SEQ ID NO: 27620 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
ttctgtcctctctgaaccac

SEQ ID NO: 27621 - DNA, 20 bp, Artificial Sequence
  Description of Artificial Sequence: Synthetic oligonucleotide
  Target: ATXN1; (-) strand; PAM type: NNNNGHTT; PAM sequence: GGGTGATT
cactgataacaagccctact

SEQ ID NO: 27622 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
tggacatgggtgagggagta

SEQ ID NO: 27623 - DNA, 20 bp, Artificial Sequence
  Description of Artificial Sequence: Synthetic oligonucleotide
  Target: ATXN1; (-) strand; PAM type: NNNNGHTT; PAM sequence: AGTAGCTT
atagtggacatgggtgaggg

SEQ ID NO: 27624 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
ctctggggcagtaccccgtc

SEQ ID NO: 27625 - DNA, 20 bp, Artificial Sequence
  Description of Artificial Sequence: Synthetic oligonucleotide
  Target: ATXN1; (-) strand; PAM type: NNNNGHTT; PAM sequence: GGGGGCTT
tgttgttggatcatctggtt

SEQ ID NO: 27626 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
gtgagggtgatgacatgagc

SEQ ID NO: 27627 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
tgaggacagctgtctggggc

SEQ ID NO: 27628 - DNA, 20 bp, Artificial Sequence
  Description of Artificial Sequence: Synthetic oligonucleotide
  Target: ATXN1; (-) strand; PAM type: NNNNGHTT; PAM sequence: CCAGGATT
atacctggttacaggctgtc

SEQ ID NO: 27629 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
gtccctccctaataagggtg

SEQ ID NO: 27630 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
atattcatatagttaatggc

SEQ ID NO: 27631 - DNA, 20 bp, Artificial Sequence
  Description of Artificial Sequence: Synthetic oligonucleotide
  Target: ATXN1; (-) strand; PAM type: NNNNGHTT; PAM sequence: GGTTGATT
ttccaatgcccagacttcag

SEQ ID NO: 27632 - DNA, 20 bp, Artificial Sequence
  Description of Artificial Sequence: Synthetic oligonucleotide
  Target: ATXN1; (-) strand; PAM type: NNNNGHTT; PAM sequence: GCCTGATT
aaaagtggtggggtcttata

SEQ ID NO: 27633 - DNA, 20 bp, Artificial Sequence
  Description of Artificial Sequence: Synthetic oligonucleotide
  Target: ATXN1; (-) strand; PAM type: NNNNGHTT; PAM sequence: ATGAGCTT
acaatatcctgtaatccttt

SEQ ID NO: 27634 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gcactagtctccactgacga

SEQ ID NO: 27635 - DNA, 20 bp, Artificial Sequence
  Description of Artificial Sequence: Synthetic oligonucleotide
  Target: ATXN1; (-) strand; PAM type: NNNNGHTT; PAM sequence: TGACGATT
gatcttgcactagtctccac

SEQ ID NO: 27636 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
ggtccagaacagtgaaacca

SEQ ID NO: 27637 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
ggcaagaccgtccatgtaag

SEQ ID NO: 27638 - DNA, 20 bp, Artificial Sequence
  Description of Artificial Sequence: Synthetic oligonucleotide
  Target: ATXN1; (-) strand; PAM type: NNNNGHTT; PAM sequence: TGAAGCTT
tctagagtagcctgctggca

SEQ ID NO: 27639 - DNA, 20 bp, Artificial Sequence
  Description of Artificial Sequence: Synthetic oligonucleotide
  Target: ATXN1; (-) strand; PAM type: NNNNGHTT; PAM sequence: CCTTGATT
tcgatttagatgccttgtac

SEQ ID NO: 27640 - DNA, 20 bp, Artificial Sequence
  Description of Artificial Sequence: Synthetic oligonucleotide
  Target: ATXN1; (-) strand; PAM type: NNNNGHTT; PAM sequence: CTTCGATT
tgttgtaggcagagctgggc

SEQ ID NO: 27641 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
cctggttcctctggctagga

SEQ ID NO: 27642 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
gagggccctggttcctctgg

SEQ ID NO: 27643 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
tgatcccaaggaacccccac

SEQ ID NO: 27644 - DNA, 20 bp, Artificial Sequence
  Description of Artificial Sequence: Synthetic oligonucleotide
  Target: ATXN1; (-) strand; PAM type: NNNNGHTT; PAM sequence: CCTTGATT
aatatttgccctctcggtct

SEQ ID NO: 27645 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
gcctgctttaaggttttgaa

SEQ ID NO: 27646 - DNA, 20 bp, Artificial Sequence
  Description of Artificial Sequence: Synthetic oligonucleotide
  Target: ATXN1; (-) strand; PAM type: NNNNGHTT; PAM sequence: TAAGGTTT
gtttgtactagggcctgctt

SEQ ID NO: 27647 - DNA, 20 bp, Artificial Sequence
  Description of Artificial Sequence: Synthetic oligonucleotide
  Target: ATXN1; (-) strand; PAM type: NNNNGHTT; PAM sequence: GCCTGCTT
agtcttgagtttgtactagg

SEQ ID NO: 27648 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
tcctggggaaggcttaagtc

SEQ ID NO: 27649 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
aagagaagttttgtcctggg

SEQ ID NO: 27650 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
tctctctgtgaggtataaag

SEQ ID NO: 27651 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
tagcgcctggtacctgagta

SEQ ID NO: 27652 - DNA, 20 bp, Artificial Sequence
  Description of Artificial Sequence: Synthetic oligonucleotide
  Target: ATXN1; (-) strand; PAM type: NNNNGHTT; PAM sequence: ACTCGATT
tacaatttgttggcagtcat

SEQ ID NO: 27653 - DNA, 20 bp, Artificial Sequence
  Description of Artificial Sequence: Synthetic oligonucleotide
  Target: ATXN1; (-) strand; PAM type: NNNNGHTT; PAM sequence: TCAGGATT
catcggtatataggttaagg

SEQ ID NO: 27654 - DNA, 20 bp, Artificial Sequence
  Description of Artificial Sequence: Synthetic oligonucleotide
  Target: ATXN1; (-) strand; PAM type: NNNNGHTT; PAM sequence: TAAGGCTT
cttttttcctttcccggttc

SEQ ID NO: 27655 - DNA, 20 bp, Artificial Sequence
  Description of Artificial Sequence: Synthetic oligonucleotide
  Target: ATXN1; (-) strand; PAM type: NNNNGHTT; PAM sequence: GTAGGATT
ccatattgcagcatgggcat

SEQ ID NO: 27656 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
agtgtaacactgccacctcc

SEQ ID NO: 27657 - DNA, 20 bp, Artificial Sequence
  Description of Artificial Sequence: Synthetic oligonucleotide
  Target: ATXN1; (-) strand; PAM type: NNNNGHTT; PAM sequence: GATGGCTT
cttttctccttcaccttttt

SEQ ID NO: 27658 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
tttggcctcagcatctgccc

SEQ ID NO: 27659 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
ctgtttcgatcagggagtac

SEQ ID NO: 27660 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
tgcccccgtgaaagtcccca

SEQ ID NO: 27661 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
gtcttaagtattttccactg

SEQ ID NO: 27662 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
agtgttctcaaacccatgtg

SEQ ID NO: 27663 - DNA, 20 bp, Artificial Sequence
  Description of Artificial Sequence: Synthetic oligonucleotide
  Target: ATXN1; (-) strand; PAM type: NNNNGHTT; PAM sequence: TAGGGATT
aggagatatggccccataaa

SEQ ID NO: 27664 - DNA, 20 bp, Artificial Sequence
  Description of Artificial Sequence: Synthetic oligonucleotide
  Target: ATXN1; (-) strand; PAM type: NNNNGHTT; PAM sequence: ACAGGCTT
tttttcctttggcacacctc

SEQ ID NO: 27665 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
aaggggccttacgatggacc

SEQ ID NO: 27666 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
gccttctccgtcttgcaggg

SEQ ID NO: 27667 - DNA, 20 bp, Artificial Sequence
  Description of Artificial Sequence: Synthetic oligonucleotide
  Target: ATXN1; (-) strand; PAM type: NNNNGHTT; PAM sequence: GTAAGCTT
agccggaccattgtcgtttt

SEQ ID NO: 27668 - DNA, 20 bp, Artificial Sequence
  Description of Artificial Sequence: Synthetic oligonucleotide
  Target: ATXN1; (-) strand; PAM type: NNNNGHTT; PAM sequence: TGTCGTTT
ggctttaagagccggaccat

SEQ ID NO: 27669 - DNA, 20 bp, Artificial Sequence
  Description of Artificial Sequence: Synthetic oligonucleotide
  Target: ATXN1; (-) strand; PAM type: NNNNGHTT; PAM sequence: CGTGGCTT
ctggaaattccctgagttac

SEQ ID NO: 27670 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
tttgccttctcagccttccc

SEQ ID NO: 27671 - DNA, 20 bp, Artificial Sequence
  Description of Artificial Sequence: Synthetic oligonucleotide
  Target: ATXN1; (-) strand; PAM type: NNNNGHTT; PAM sequence: TTTCGTTT
ccttaagtgcctcttgagtg

SEQ ID NO: 27672 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
cgtttccttaagtgcctctt

SEQ ID NO: 27673 - DNA, 20 bp, Artificial Sequence
  Description of Artificial Sequence: Synthetic oligonucleotide
  Target: ATXN1; (-) strand; PAM type: NNNNGHTT; PAM sequence: GTTCGTTT
atgggagatgagtttcttgt

SEQ ID NO: 27674 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
aagagagtaggccatgggag

SEQ ID NO: 27675 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
ccccattttgtgaggagaat

SEQ ID NO: 27676 - DNA, 20 bp, Artificial Sequence
  Description of Artificial Sequence: Synthetic oligonucleotide
  Target: ATXN1; (-) strand; PAM type: NNNNGHTT; PAM sequence: GGCCGTTT
gttatatctttgaccaactt

SEQ ID NO: 27677 - DNA, 20 bp, Artificial Sequence
  Description of Artificial Sequence: Synthetic oligonucleotide
  Target: ATXN1; (-) strand; PAM type: NNNNGHTT; PAM sequence: TAACGTTT
acatcctttgggtaggtttt

SEQ ID NO: 27678 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
gtctctgtgacatcctttgg

SEQ ID NO: 27679 - DNA, 20 bp, Artificial Sequence
  Description of Artificial Sequence: Synthetic oligonucleotide
  Target: ATXN1; (-) strand; PAM type: NNNNGHTT; PAM sequence: AGAGGATT
cttaactgcagtgggggtag

SEQ ID NO: 27680 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
ttaactcgcatgtagtgaat

SEQ ID NO: 27681 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
caggttcttcagggggtgtc

SEQ ID NO: 27682 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
cacaaatcttccaatggttc

SEQ ID NO: 27683 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
ataggggcctttttagtctg

SEQ ID NO: 27684 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
cttatcctttttaaatagga

SEQ ID NO: 27685 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
ggagtggtgttaaagattat

SEQ ID NO: 27686 - DNA, 20 bp, Artificial Sequence
  Description of Artificial Sequence: Synthetic oligonucleotide
  Target: ATXN1; (-) strand; PAM type: NNNNGHTT; PAM sequence: TAAAGATT
aaaggggcaaggagtggtgt

SEQ ID NO: 27687 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
aataatgtgatgaaactgta

SEQ ID NO: 27688 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
tgcaaagagaatggttagta

SEQ ID NO: 27689 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
tgtaaaaaaggttgatgtga

SEQ ID NO: 27690 - DNA, 20 bp, Artificial Sequence
  Description of Artificial Sequence: Synthetic oligonucleotide
  Target: ATXN1; (-) strand; PAM type: NNNNGHTT; PAM sequence: ATGTGATT
attgcatgtaaaaaaggttg

SEQ ID NO: 27691 - DNA, 20 bp, Artificial Sequence
  Description of Artificial Sequence: Synthetic oligonucleotide
  Target: ATXN1; (-) strand; PAM type: NNNNGHTT; PAM sequence: GCTGGATT
ggaaatgtaagagcgtaaaa

SEQ ID NO: 27692 - DNA, 20 bp, Artificial Sequence
  Description of Artificial Sequence: Synthetic oligonucleotide
  Target: ATXN1; (-) strand; PAM type: NNNNGHTT; PAM sequence: CAGGGCTT
taagatggtattcacggtta

SEQ ID NO: 27693 - DNA, 20 bp, Artificial Sequence
  Description of Artificial Sequence: Synthetic oligonucleotide
  Target: ATXN1; (-) strand; PAM type: NNNNGHTT; PAM sequence: CGGGGCTT
aggttgcgttggatgcataa

SEQ ID NO: 27694 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
tggaagttactatgatcatt

SEQ ID NO: 27695 - DNA, 20 bp, Artificial Sequence
  Description of Artificial Sequence: Synthetic oligonucleotide
  Target: ATXN1; (-) strand; PAM type: NNNNGHTT; PAM sequence: AGCGGTTT
cggacaagccatctgaatag

SEQ ID NO: 27696 - DNA, 20 bp, Artificial Sequence
  Description of Artificial Sequence: Synthetic oligonucleotide
  Target: ATXN1; (-) strand; PAM type: NNNNGHTT; PAM sequence: TGATGATT
tttgttaagcagggaggagg

SEQ ID NO: 27697 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
gtttgccattacaaaacctg

SEQ ID NO: 27698 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
ggtgaatagtcatacaggga

SEQ ID NO: 27699 - DNA, 20 bp, Artificial Sequence
  Description of Artificial Sequence: Synthetic oligonucleotide
  Target: ATXN1; (-) strand; PAM type: NNNNGHTT; PAM sequence: GAGTGATT
ctactaggaaccattcaaga

SEQ ID NO: 27700 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
tattttcccattggagaaaa

SEQ ID NO: 27701 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
gttaaaaaggtgtgtgagtt

SEQ ID NO: 27702 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
tgtgtatgttaaaaaggtgt

SEQ ID NO: 27703 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
ctttgaggggcactgatagg

SEQ ID NO: 27704 - DNA, 20 bp, Artificial Sequence
  Description of Artificial Sequence: Synthetic oligonucleotide
  Target: ATXN1; (-) strand; PAM type: NNNNGHTT; PAM sequence: CTGAGCTT
atggccctgtactgacggac

SEQ ID NO: 27705 - DNA, 20 bp, Artificial Sequence
  Description of Artificial Sequence: Synthetic oligonucleotide
  Target: ATXN1; (-) strand; PAM type: NNNNGHTT; PAM sequence: GATAGATT
atttgggattgcagagtaag

SEQ ID NO: 27706 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
actactgccaaagagtctat

SEQ ID NO: 27707 - DNA, 20 bp, Artificial Sequence
  Description of Artificial Sequence: Synthetic oligonucleotide
  Target: ATXN1; (-) strand; PAM type: NNNNGHTT; PAM sequence: GGCGGTTT
agtgaggaggtctaggcctt

SEQ ID NO: 27708 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
ataagagtttgaaaggcatt

SEQ ID NO: 27709 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
ccaactctagaggttggtat

SEQ ID NO: 27710 - DNA, 20 bp, Artificial Sequence
  Description of Artificial Sequence: Synthetic oligonucleotide
  Target: ATXN1; (-) strand; PAM type: NNNNGHTT; PAM sequence: TGTAGCTT
gttccatttgtaagaccatc

SEQ ID NO: 27711 - DNA, 20 bp, Artificial Sequence
  Description of Artificial Sequence: Synthetic oligonucleotide
  Target: ATXN1; (-) strand; PAM type: NNNNGHTT; PAM sequence: TCCTGATT
ctcttgtaagacaggaaagt

SEQ ID NO: 27712 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
tattggtgcattttacaaag

SEQ ID NO: 27713 - DNA, 20 bp, Artificial Sequence
  Description of Artificial Sequence: Synthetic oligonucleotide
  Target: ATXN1; (-) strand; PAM type: NNNNGHTT; PAM sequence: GTGCGTTT
attttacagagcactaattg

SEQ ID NO: 27714 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
attggctacctttagaatcc

SEQ ID NO: 27715 - DNA, 20 bp, Artificial Sequence
  Description of Artificial Sequence: Synthetic oligonucleotide
  Target: ATXN1; (-) strand; PAM type: NNNNGHTT; PAM sequence: CTGCGATT
gccctttttttcaatcctcc

SEQ ID NO: 27716 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
tgctgctgctggctgtggtg

SEQ ID NO: 27717 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
tattgtgaagagcaaaagga

SEQ ID NO: 27718 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
acccaaagagtgagcagtag

SEQ ID NO: 27719 - DNA, 20 bp, Artificial Sequence
  Description of Artificial Sequence: Synthetic oligonucleotide
  Target: ATXN1; (-) strand; PAM type: NNNNGHTT; PAM sequence: GTGGGTTT
tctggagttggttcctaccg

SEQ ID NO: 27720 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
tttcatgtggcaatatgcgt

SEQ ID NO: 27721 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
acagtatgtacccttttcac

SEQ ID NO: 27722 - DNA, 20 bp, Artificial Sequence
  Description of Artificial Sequence: Synthetic oligonucleotide
  Target: ATXN1; (-) strand; PAM type: NNNNGHTT; PAM sequence: TGTAGCTT
ttttttttttttactatccc

SEQ ID NO: 27723 - DNA, 20 bp, Artificial Sequence
  Description of Artificial Sequence: Synthetic oligonucleotide
  Target: ATXN1; (-) strand; PAM type: NNNNGHTT; PAM sequence: CCCTGATT
ttcctcccaatccccaaaac

SEQ ID NO: 27724 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
tgtcctaacaactctttgtg

SEQ ID NO: 27725 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
cattcttcctgttgtacatt

SEQ ID NO: 27726 - DNA, 20 bp, Artificial Sequence
  Description of Artificial Sequence: Synthetic oligonucleotide
  Target: ATXN1; (-) strand; PAM type: NNNNGHTT; PAM sequence: AATTGATT
cagttttaggtttacagaaa

SEQ ID NO: 27727 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
ggcttttttatagaacagtt

SEQ ID NO: 27728 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
attaataggcttttttatag

SEQ ID NO: 27729 - DNA, 20 bp, Artificial Sequence
  Description of Artificial Sequence: Synthetic oligonucleotide
  Target: ATXN1; (-) strand; PAM type: NNNNGHTT; PAM sequence: ATAGGCTT
ttgtttttgttttttaatta

SEQ ID NO: 27730 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cagtgcagtgttgttgttgt

SEQ ID NO: 27731 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
agctgtcagtgcagtgttgt

SEQ ID NO: 27732 - DNA, 20 bp, Artificial Sequence
  Description of Artificial Sequence: Synthetic oligonucleotide
  Target: ATXN1; (-) strand; PAM type: NNNNGHTT; PAM sequence: GCCTGATT
acacccagccgttgcacctt

SEQ ID NO: 27733 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgccttggcctcccaaagtg

SEQ ID NO: 27734 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttctatttttagtagaga

SEQ ID NO: 27735 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tgattttttgttttgttttg

SEQ ID NO: 27736 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ttccctgattttttgttttg

SEQ ID NO: 27737 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gcaccttccctgattttttg

SEQ ID NO: 27738 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ttatggcaccttccctgatt

SEQ ID NO: 27739 - DNA, 20 bp, Artificial Sequence
  Description of Artificial Sequence: Synthetic oligonucleotide
  Target: ATXN1; (-) strand; PAM type: NNNNGHTT; PAM sequence: CCCTGATT
agtcatctttatggcacctt

SEQ ID NO: 27740 - DNA, 20 bp, Artificial Sequence
  Description of Artificial Sequence: Synthetic oligonucleotide
  Target: ATXN1; (-) strand; PAM type: NNNNGHTT; PAM sequence: GGAGGCTT
agttcttctgctaaagaact

SEQ ID NO: 27741 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
agtctggagtgactctgtct

SEQ ID NO: 27742 - DNA, 20 bp, Artificial Sequence
  Description of Artificial Sequence: Synthetic oligonucleotide
  Target: ATXN1; (-) strand; PAM type: NNNNGHTT; PAM sequence: ATGAGCTT
tacatcattttgattgcatc

SEQ ID NO: 27743 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
agacacctcttggtacatca

SEQ ID NO: 27744 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
tcccttagaatccttgtatt

SEQ ID NO: 27745 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
agaagttattcctcttccat

SEQ ID NO: 27746 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgccttggcctcccaaagtg

SEQ ID NO: 27747 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttagtagaga

SEQ ID NO: 27748 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctccctagtag

SEQ ID NO: 27749 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
ctctgcccccgcctgggtac

SEQ ID NO: 27750 - DNA, 20 bp, Artificial Sequence
  Description of Artificial Sequence: Synthetic oligonucleotide
  Target: ATXN1; (-) strand; PAM type: NNNNGHTT; PAM sequence: CTTCGATT
tgaatgtaagagtgaaagtt

SEQ ID NO: 27751 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
tgtctttccatctgaattat

SEQ ID NO: 27752 - DNA, 20 bp, Artificial Sequence
  Description of Artificial Sequence: Synthetic oligonucleotide
  Target: ATXN1; (-) strand; PAM type: NNNNGHTT; PAM sequence: TCGTGCTT
gtagctttacagaaatagaa

SEQ ID NO: 27753 - DNA, 20 bp, Artificial Sequence
  Description of Artificial Sequence: Synthetic oligonucleotide
  Target: ATXN1; (-) strand; PAM type: NNNNGHTT; PAM sequence: TGTAGCTT
tatatatacaaataaataca

SEQ ID NO: 27754 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
atttgagtgtgttttcttcc

SEQ ID NO: 27755 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
tcaccaccgttagcatttga

SEQ ID NO: 27756 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
cttttacatggattctctgt

SEQ ID NO: 27757 - DNA, 20 bp, Artificial Sequence
  Description of Artificial Sequence: Synthetic oligonucleotide
  Target: ATXN1; (-) strand; PAM type: NNNNGHTT; PAM sequence: CATGGATT
ttgaaaacattagtctttta

SEQ ID NO: 27758 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
cacagtcatttaatgcaaac

SEQ ID NO: 27759 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
gctttttgaaatttccattc

SEQ ID NO: 27760 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
cttccattactttttgtgac

SEQ ID NO: 27761 - DNA, 20 bp, Artificial Sequence
  Description of Artificial Sequence: Synthetic oligonucleotide
  Target: ATXN1; (-) strand; PAM type: NNNNGHTT; PAM sequence: GGGTGTTT
catacataatttgcatcatg

SEQ ID NO: 27762 - DNA, 20 bp, Artificial Sequence
  Description of Artificial Sequence: Synthetic oligonucleotide
  Target: ATXN1; (-) strand; PAM type: NNNNGHTT; PAM sequence: CCACGCTT
atatctccgtgatagaataa

SEQ ID NO: 27763 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
gtgattggaccgtgcgtccc

SEQ ID NO: 27764 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
caaacagtaaaacctgacac

SEQ ID NO: 27765 - DNA, 20 bp, Artificial Sequence
  Description of Artificial Sequence: Synthetic oligonucleotide
  Target: ATXN1; (-) strand; PAM type: NNNNGHTT; PAM sequence: AGTAGTTT
ccctcctctgcatgtaaagc

SEQ ID NO: 27766 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
tgattaaaggtacttattgt

SEQ ID NO: 27767 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
aagaatggaaaacaaatggc

SEQ ID NO: 27768 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
atagaaaagaatggaaaaca

SEQ ID NO: 27769 - DNA, 20 bp, Artificial Sequence
  Description of Artificial Sequence: Synthetic oligonucleotide
  Target: ATXN1; (-) strand; PAM type: NNNNGHTT; PAM sequence: ATAGGATT
catactcctacattaatgca

SEQ ID NO: 27770 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
acagtttaaaatgaactgtt

SEQ ID NO: 27771 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
aggcaatacagtttaaaatg

SEQ ID NO: 27772 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
acagggttgttaacaggcaa

SEQ ID NO: 27773 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
ggtcttcttgtaggcagtgg

SEQ ID NO: 27774 - DNA, 20 bp, Artificial Sequence
  Description of Artificial Sequence: Synthetic oligonucleotide
  Target: ATXN1; (-) strand; PAM type: NNNNGHTT; PAM sequence: CCGTGTTT
tgtctttaccaagagaatat

SEQ ID NO: 27775 - DNA, 20 bp, Artificial Sequence
  Description of Artificial Sequence: Synthetic oligonucleotide
  Target: ATXN1; (-) strand; PAM type: NNNNGHTT; PAM sequence: CTATGATT
tgttactgccactgcaattc

SEQ ID NO: 27776 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
aataggagacaaattattat

SEQ ID NO: 27777 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
cttactttagtctctagcct

SEQ ID NO: 27778 - DNA, 20 bp, Artificial Sequence
  Description of Artificial Sequence: Synthetic oligonucleotide
  Target: ATXN1; (-) strand; PAM type: NNNNGHTT; PAM sequence: TGGAGCTT
aatggcgtgaacctgggaag

SEQ ID NO: 27779 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
tgactgttcattcatcccac

SEQ ID NO: 27780 - DNA, 20 bp, Artificial Sequence
  Description of Artificial Sequence: Synthetic oligonucleotide
  Target: ATXN1; (-) strand; PAM type: NNNNGHTT; PAM sequence: ACTCGCTT
ctagcccagggatagcatat

SEQ ID NO: 27781 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
cttttggctaatttgctttg

SEQ ID NO: 27782 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
acttttgcctcttttggcta

SEQ ID NO: 27783 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
ctcttaggacattgttaaca

SEQ ID NO: 27784 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
atcagccatgtacagttttt

SEQ ID NO: 27785 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
tatttccaatatcagccatg

SEQ ID NO: 27786 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
tgttctgttcaaaagtaagg

SEQ ID NO: 27787 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
cagaagaagcatcgatctaa

SEQ ID NO: 27788 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
cagtcctacctttttttttt

SEQ ID NO: 27789 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
atgagtggatcaacctctga

SEQ ID NO: 27790 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
cagctctgttgcacagtttt

SEQ ID NO: 27791 - DNA, 20 bp, Artificial Sequence
  Description of Artificial Sequence: Synthetic oligonucleotide
  Target: ATXN1; (-) strand; PAM type: NNNNGHTT; PAM sequence: CACAGTTT
gccaagggccagctctgttg

SEQ ID NO: 27792 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
tttaaaactctgcctttcta

SEQ ID NO: 27793 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
aagactcttgtataattgct

SEQ ID NO: 27794 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
tttgcttctcctgatagaat

SEQ ID NO: 27795 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tgtattaaacttatttatat

SEQ ID NO: 27796 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
gtttaattagatcctatctt

SEQ ID NO: 27797 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
atattagcaccttggtgtga

SEQ ID NO: 27798 - DNA, 20 bp, Artificial Sequence
  Description of Artificial Sequence: Synthetic oligonucleotide
  Target: ATXN1; (-) strand; PAM type: NNNNGHTT; PAM sequence: GCTAGTTT
agtatcaagcaaagccatca

SEQ ID NO: 27799 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
ttcacgtctttattagatac

SEQ ID NO: 27800 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcggcctcccaaagca

SEQ ID NO: 27801 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtatttttagtagggt

SEQ ID NO: 27802 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaagtag

SEQ ID NO: 27803 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
tcttttttttttttttgaga

SEQ ID NO: 27804 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
gcacttgggttgcttccacc

SEQ ID NO: 27805 - DNA, 20 bp, Artificial Sequence
  Description of Artificial Sequence: Synthetic oligonucleotide
  Target: ATXN1; (-) strand; PAM type: NNNNGHTT; PAM sequence: GGTTGCTT
catctatcagtgggcacttg

SEQ ID NO: 27806 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
tgttgtatgtgtagaccaca

SEQ ID NO: 27807 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
atagttcaccaacataattt

SEQ ID NO: 27808 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
ataatcagataactttgcat

SEQ ID NO: 27809 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
cttttgggtgtcatttttca

SEQ ID NO: 27810 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
catggcctgaatttttttaa

SEQ ID NO: 27811 - DNA, 20 bp, Artificial Sequence
  Description of Artificial Sequence: Synthetic oligonucleotide
  Target: ATXN1; (-) strand; PAM type: NNNNGHTT; PAM sequence: GAAGGATT
ttttcaaaggctaagggttg

SEQ ID NO: 27812 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gaaatttcaaagtaggcgca

SEQ ID NO: 27813 - DNA, 20 bp, Artificial Sequence
  Description of Artificial Sequence: Synthetic oligonucleotide
  Target: ATXN1; (-) strand; PAM type: NNNNGHTT; PAM sequence: CGCAGTTT
gggggaaatttcaaagtagg

SEQ ID NO: 27814 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
agattattggaatgagaaag

SEQ ID NO: 27815 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
cagaagtctttcagatagca

SEQ ID NO: 27816 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
gtgtgtgtgtgtgtgtgtgt

SEQ ID NO: 27817 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
atcttctgatgaagcccttt

SEQ ID NO: 27818 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
tgaaaattcaaaattacttc

SEQ ID NO: 27819 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
tctcaaattactaaccatag

SEQ ID NO: 27820 - DNA, 20 bp, Artificial Sequence
  Description of Artificial Sequence: Synthetic oligonucleotide
  Target: ATXN1; (-) strand; PAM type: NNNNGHTT; PAM sequence: TCTAGATT
tctattacatcattcacata

SEQ ID NO: 27821 - DNA, 20 bp, Artificial Sequence
  Description of Artificial Sequence: Synthetic oligonucleotide
  Target: ATXN1; (-) strand; PAM type: NNNNGHTT; PAM sequence: GGCTGCTT
gaatctaatccagggcacat

SEQ ID NO: 27822 - DNA, 20 bp, Artificial Sequence
  Description of Artificial Sequence: Synthetic oligonucleotide
  Target: ATXN1; (-) strand; PAM type: NNNNGHTT; PAM sequence: CGGAGATT
ctaaggtctgacagatggtg

SEQ ID NO: 27823 - DNA, 20 bp, Artificial Sequence
  Description of Artificial Sequence: Synthetic oligonucleotide
  Target: ATXN1; (-) strand; PAM type: NNNNGHTT; PAM sequence: TCTTGATT
ctacacacttggttgcctct

SEQ ID NO: 27824 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
ctgtgattaaaaccacctcc

SEQ ID NO: 27825 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
gtatgcaatcaaagtcaaca

SEQ ID NO: 27826 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
gccacctgcgtgttatttca

SEQ ID NO: 27827 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
tacaaacacatgaccttaca

SEQ ID NO: 27828 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
gactggagagatacccaatt

SEQ ID NO: 27829 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
gtgccagaagaagggatgag

SEQ ID NO: 27830 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
gtttgctgtgttcaatctgg

SEQ ID NO: 27831 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
attctatactgaaaggaaga

SEQ ID NO: 27832 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
tggaattcctgattctgctt

SEQ ID NO: 27833 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
gcatgttttggaattcctga

SEQ ID NO: 27834 - DNA, 20 bp, Artificial Sequence
  Description of Artificial Sequence: Synthetic oligonucleotide
  Target: ATXN1; (-) strand; PAM type: NNNNGHTT; PAM sequence: TCCTGATT
aacatggcatgttttggaat

SEQ ID NO: 27835 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
gaaatggaaatgaaaacatg

SEQ ID NO: 27836 - DNA, 20 bp, Artificial Sequence
  Description of Artificial Sequence: Synthetic oligonucleotide
  Target: ATXN1; (-) strand; PAM type: NNNNGHTT; PAM sequence: GTGAGCTT
atttaaagtgcccaaatttg

SEQ ID NO: 27837 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
catgctcggagcctgcaggc

SEQ ID NO: 27838 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
atgcattttcaaagacagga

SEQ ID NO: 27839 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
gctctggcacctttaggggt

SEQ ID NO: 27840 - DNA, 20 bp, Artificial Sequence
  Description of Artificial Sequence: Synthetic oligonucleotide
  Target: ATXN1; (-) strand; PAM type: NNNNGHTT; PAM sequence: GACTGATT
tcaaagagttcgaacagact

SEQ ID NO: 27841 - DNA, 20 bp, Artificial Sequence
  Description of Artificial Sequence: Synthetic oligonucleotide
  Target: ATXN1; (-) strand; PAM type: NNNNGHTT; PAM sequence: CTCAGATT
caggcaggccacttttgtag

SEQ ID NO: 27842 - DNA, 20 bp, Artificial Sequence
  Description of Artificial Sequence: Synthetic oligonucleotide
  Target: ATXN1; (-) strand; PAM type: NNNNGHTT; PAM sequence: CCAAGTTT
gcgatgcagataataatttg

SEQ ID NO: 27843 - DNA, 20 bp, Artificial Sequence
  Description of Artificial Sequence: Synthetic oligonucleotide
  Target: ATXN1; (-) strand; PAM type: NNNNGHTT; PAM sequence: ACCAGTTT
tttcaccggtacgtttgggg

SEQ ID NO: 27844 - DNA, 20 bp, Artificial Sequence
  Description of Artificial Sequence: Synthetic oligonucleotide
  Target: ATXN1; (-) strand; PAM type: NNNNGHTT; PAM sequence: GTACGTTT
agaacgtgtggttttcaccg

SEQ ID NO: 27845 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
agtcgccaagagtgagaacg

SEQ ID NO: 27846 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
caaaaggcaaaaatagaaat

SEQ ID NO: 27847 - DNA, 20 bp, Artificial Sequence
  Description of Artificial Sequence: Synthetic oligonucleotide
  Target: ATXN1; (-) strand; PAM type: NNNNGHTT; PAM sequence: CCATGCTT
ttctctgacctcggatagga

SEQ ID NO: 27848 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
aaggctctggggcactctca

SEQ ID NO: 27849 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
caaagactcttttccttcca

SEQ ID NO: 27850 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
cctaccaaggggctgagtca

SEQ ID NO: 27851 - DNA, 20 bp, Artificial Sequence
  Description of Artificial Sequence: Synthetic oligonucleotide
  Target: ATXN1; (-) strand; PAM type: NNNNGHTT; PAM sequence: GGAAGTTT
tcgttagcctagacaattca

SEQ ID NO: 27852 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
gacaggggagtggtcattga

SEQ ID NO: 27853 - DNA, 20 bp, Artificial Sequence
  Description of Artificial Sequence: Synthetic oligonucleotide
  Target: ATXN1; (-) strand; PAM type: NNNNGHTT; PAM sequence: TAGAGTTT
gtaagttctgctgaggagtt

SEQ ID NO: 27854 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
cttttcagtaagttctgctg

SEQ ID NO: 27855 - DNA, 20 bp, Artificial Sequence
  Description of Artificial Sequence: Synthetic oligonucleotide
  Target: ATXN1; (-) strand; PAM type: NNNNGHTT; PAM sequence: AGTAGTTT
tggcatgttggaagacagca

SEQ ID NO: 27856 - DNA, 20 bp, Artificial Sequence
  Description of Artificial Sequence: Synthetic oligonucleotide
  Target: ATXN1; (-) strand; PAM type: NNNNGHTT; PAM sequence: AGATGCTT
gcttttcaagctctgcttca

SEQ ID NO: 27857 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
gtgcatgagtgcttttcaag

SEQ ID NO: 27858 - DNA, 20 bp, Artificial Sequence
  Description of Artificial Sequence: Synthetic oligonucleotide
  Target: ATXN1; (-) strand; PAM type: NNNNGHTT; PAM sequence: GAGTGCTT
aagggcaagccccagtgcat

SEQ ID NO: 27859 - DNA, 20 bp, Artificial Sequence
  Description of Artificial Sequence: Synthetic oligonucleotide
  Target: ATXN1; (-) strand; PAM type: NNNNGHTT; PAM sequence: CTGAGCTT
tcatcctccagtagactagt

SEQ ID NO: 27860 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
cttcagctgggacagcttgt

SEQ ID NO: 27861 - DNA, 20 bp, Artificial Sequence
  Description of Artificial Sequence: Synthetic oligonucleotide
  Target: ATXN1; (-) strand; PAM type: NNNNGHTT; PAM sequence: GACAGCTT
gatgggtgatcttcagctgg

SEQ ID NO: 27862 - DNA, 20 bp, Artificial Sequence
  Description of Artificial Sequence: Synthetic oligonucleotide
  Target: ATXN1; (-) strand; PAM type: NNNNGHTT; PAM sequence: GCTGGTTT
actcacatagctactagaag

SEQ ID NO: 27863 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
cctggactattttagtctgg

SEQ ID NO: 27864 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
taagggccaagaccacaatc

SEQ ID NO: 27865 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
atggcatcttctgggatcag

SEQ ID NO: 27866 - DNA, 20 bp, Artificial Sequence
  Description of Artificial Sequence: Synthetic oligonucleotide
  Target: ATXN1; (-) strand; PAM type: NNNNGHTT; PAM sequence: AGGAGCTT
taggcacctacagtagttaa

SEQ ID NO: 27867 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
tctcatctataaaaggagta

SEQ ID NO: 27868 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
tagtcaaactgaaaggcaca

SEQ ID NO: 27869 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
ggttatgtattgttaagacc

SEQ ID NO: 27870 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
agtctgttaagtttttagcc

SEQ ID NO: 27871 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
gttaaatgcgataaagtctg

SEQ ID NO: 27872 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
ctctttgaatcacatttggg

SEQ ID NO: 27873 - DNA, 20 bp, Artificial Sequence
  Description of Artificial Sequence: Synthetic oligonucleotide
  Target: ATXN1; (-) strand; PAM type: NNNNGHTT; PAM sequence: ATCAGATT
tatcactgccacttaacagc

SEQ ID NO: 27874 - DNA, 20 bp, Artificial Sequence
  Description of Artificial Sequence: Synthetic oligonucleotide
  Target: ATXN1; (-) strand; PAM type: NNNNGHTT; PAM sequence: TCGTGCTT
ccagttaggtttcatgaact

SEQ ID NO: 27875 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
taaagtagatgatagaccag

SEQ ID NO: 27876 - DNA, 20 bp, Artificial Sequence
  Description of Artificial Sequence: Synthetic oligonucleotide
  Target: ATXN1; (-) strand; PAM type: NNNNGHTT; PAM sequence: GGTTGCTT
aattcttctctgggtttgat

SEQ ID NO: 27877 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
tagaagcttcaaattcttct

SEQ ID NO: 27878 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
atgtgaatggcattaaagtt

SEQ ID NO: 27879 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
ataactgttaattcaacact

SEQ ID NO: 27880 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
ttttgttttttgtttttttt

SEQ ID NO: 27881 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ggagaagtacagtttttgtt

SEQ ID NO: 27882 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
atacagtggagaagtacagt

SEQ ID NO: 27883 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
attttgatacagtggagaag

SEQ ID NO: 27884 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
gtcattattttaaattgaca

SEQ ID NO: 27885 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tatgagataaagtaaatcag

SEQ ID NO: 27886 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
ttttgtatgagataaagtaa

SEQ ID NO: 27887 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
cagagcatcccatattttca

SEQ ID NO: 27888 - DNA, 20 bp, Artificial Sequence
  Description of Artificial Sequence: Synthetic oligonucleotide
  Target: ATXN1; (-) strand; PAM type: NNNNGHTT; PAM sequence: GCACGTTT
ggtgtaactgaccatttcta

SEQ ID NO: 27889 - DNA, 20 bp, Artificial Sequence
  Description of Artificial Sequence: Synthetic oligonucleotide
  Target: ATXN1; (-) strand; PAM type: NNNNGHTT; PAM sequence: GTGTGCTT
cgagataattgcatgaaact

SEQ ID NO: 27890 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
gcctttcccttcacgactaa

SEQ ID NO: 27891 - DNA, 20 bp, Artificial Sequence
  Description of Artificial Sequence: Synthetic oligonucleotide
  Target: ATXN1; (-) strand; PAM type: NNNNGHTT; PAM sequence: GAGTGCTT
tgggtgacattttctcctga

SEQ ID NO: 27892 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
tctgtggaagcccctaggca

SEQ ID NO: 27893 - DNA, 20 bp, Artificial Sequence
  Description of Artificial Sequence: Synthetic oligonucleotide
  Target: ATXN1; (-) strand; PAM type: NNNNGHTT; PAM sequence: GGGGGCTT
caagtgacattggcagagct

SEQ ID NO: 27894 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
tccaaagaacatagaaatac

SEQ ID NO: 27895 - DNA, 20 bp, Artificial Sequence
  Description of Artificial Sequence: Synthetic oligonucleotide
  Target: ATXN1; (-) strand; PAM type: NNNNGHTT; PAM sequence: TTCCGATT
aaatgactttttctgccatt

SEQ ID NO: 27896 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
gcagagttggagacatgagt

SEQ ID NO: 27897 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
gtgaattaggttaatgtttt

SEQ ID NO: 27898 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tcttgtgaattaggttaatg

SEQ ID NO: 27899 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
gtttttcttgtgaattaggt

SEQ ID NO: 27900 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
atctcaaagcatctgatggt

SEQ ID NO: 27901 - DNA, 20 bp, Artificial Sequence
  Description of Artificial Sequence: Synthetic oligonucleotide
  Target: ATXN1; (-) strand; PAM type: NNNNGHTT; PAM sequence: AGAGGATT
ttggcagtcaccttgctcaa

SEQ ID NO: 27902 - DNA, 20 bp, Artificial Sequence
  Description of Artificial Sequence: Synthetic oligonucleotide
  Target: ATXN1; (-) strand; PAM type: NNNNGHTT; PAM sequence: TGGCGTTT
cagtatctcatcactgtcat

SEQ ID NO: 27903 - DNA, 20 bp, Artificial Sequence
  Description of Artificial Sequence: Synthetic oligonucleotide
  Target: ATXN1; (-) strand; PAM type: NNNNGHTT; PAM sequence: GACAGATT
ctcggtcacttgctataggg

SEQ ID NO: 27904 - DNA, 20 bp, Artificial Sequence
  Description of Artificial Sequence: Synthetic oligonucleotide
  Target: ATXN1; (-) strand; PAM type: NNNNGHTT; PAM sequence: TTCGGCTT
cctgtttctggctgtcatac

SEQ ID NO: 27905 - DNA, 20 bp, Artificial Sequence
  Description of Artificial Sequence: Synthetic oligonucleotide
  Target: ATXN1; (-) strand; PAM type: NNNNGHTT; PAM sequence: ACCTGTTT
ttggcaacctcaatggctct

SEQ ID NO: 27906 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
ccaaacagattgttttttcc

SEQ ID NO: 27907 - DNA, 20 bp, Artificial Sequence
  Description of Artificial Sequence: Synthetic oligonucleotide
  Target: ATXN1; (-) strand; PAM type: NNNNGHTT; PAM sequence: GATTGTTT
agctattgcttgtccaaaca

SEQ ID NO: 27908 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
agaaagctattgcttgtcca

SEQ ID NO: 27909 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
ttgttcagaaaggagaaagc

SEQ ID NO: 27910 - DNA, 20 bp, Artificial Sequence
  Description of Artificial Sequence: Synthetic oligonucleotide
  Target: ATXN1; (-) strand; PAM type: NNNNGHTT; PAM sequence: TCCGGTTT
accatggcaagccctagttt

SEQ ID NO: 27911 - DNA, 20 bp, Artificial Sequence
  Description of Artificial Sequence: Synthetic oligonucleotide
  Target: ATXN1; (-) strand; PAM type: NNNNGHTT; PAM sequence: CCTAGTTT
cttcttcaaccatggcaagc

SEQ ID NO: 27912 - DNA, 20 bp, Artificial Sequence
  Description of Artificial Sequence: Synthetic oligonucleotide
  Target: ATXN1; (-) strand; PAM type: NNNNGHTT; PAM sequence: CAAAGATT
agaacaaagagaactgggca

SEQ ID NO: 27913 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
ctttcttcttcccaagcctt

SEQ ID NO: 27914 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
ctcttgataaaatggttttc

SEQ ID NO: 27915 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
aataaaaatgctcttgataa

SEQ ID NO: 27916 - DNA, 20 bp, Artificial Sequence
  Description of Artificial Sequence: Synthetic oligonucleotide
  Target: ATXN1; (-) strand; PAM type: NNNNGHTT; PAM sequence: ACGTGTTT
caggtcccaggctgttggtt

SEQ ID NO: 27917 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
cttttatttccaaaactcag

SEQ ID NO: 27918 - DNA, 20 bp, Artificial Sequence
  Description of Artificial Sequence: Synthetic oligonucleotide
  Target: ATXN1; (-) strand; PAM type: NNNNGHTT; PAM sequence: ACTTGCTT
gtgcttatattcctgaaaca

SEQ ID NO: 27919 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
agagcaatttttttttgtat

SEQ ID NO: 27920 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
tcaaacctatgttagagaaa

SEQ ID NO: 27921 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
ttgaggtgtgatagcaaatt

SEQ ID NO: 27922 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
agtcatttttgacaagtata

SEQ ID NO: 27923 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
gacacctaaacaagtatgtt

SEQ ID NO: 27924 - DNA, 20 bp, Artificial Sequence
  Description of Artificial Sequence: Synthetic oligonucleotide
  Target: ATXN1; (-) strand; PAM type: NNNNGHTT; PAM sequence: TGAAGATT
aatccatcttctataaatcc

SEQ ID NO: 27925 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
tagtgataagaactagttga

SEQ ID NO: 27926 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
cctcccagcattagtaaggg

SEQ ID NO: 27927 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cacctcggcttcccaaaatg

SEQ ID NO: 27928 - DNA, 20 bp, Artificial Sequence
  Description of Artificial Sequence: Synthetic oligonucleotide
  Target: ATXN1; (-) strand; PAM type: NNNNGHTT; PAM sequence: CTCGGCTT
agctcaagtgatctgcccac

SEQ ID NO: 27929 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
ttttgtattttttgtagaga

SEQ ID NO: 27930 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaagtag

SEQ ID NO: 27931 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctccaccttctgggttc

SEQ ID NO: 27932 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
acactgacaaaaacatagca

SEQ ID NO: 27933 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
tttccttccatcagaaattg

SEQ ID NO: 27934 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
agagctttccttccatcaga

SEQ ID NO: 27935 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
ggcatgtgagagctcagagc

SEQ ID NO: 27936 - DNA, 20 bp, Artificial Sequence
  Description of Artificial Sequence: Synthetic oligonucleotide
  Target: ATXN1; (-) strand; PAM type: NNNNGHTT; PAM sequence: GGATGCTT
gtgtatttagagaagacaaa

SEQ ID NO: 27937 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
aaaatgcttttgtgtcctct

SEQ ID NO: 27938 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
aactgaatagtgccaaggta

SEQ ID NO: 27939 - DNA, 20 bp, Artificial Sequence
  Description of Artificial Sequence: Synthetic oligonucleotide
  Target: ATXN1; (-) strand; PAM type: NNNNGHTT; PAM sequence: GGCTGCTT
caacatcaacagcctggtca

SEQ ID NO: 27940 - DNA, 20 bp, Artificial Sequence
  Description of Artificial Sequence: Synthetic oligonucleotide
  Target: ATXN1; (-) strand; PAM type: NNNNGHTT; PAM sequence: CACTGCTT
ggcagggtctttgcaggagt

SEQ ID NO: 27941 - DNA, 20 bp, Artificial Sequence
  Description of Artificial Sequence: Synthetic oligonucleotide
  Target: ATXN1; (-) strand; PAM type: NNNNGHTT; PAM sequence: GACAGCTT
tccttgaatggcttctgatt

SEQ ID NO: 27942 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
ctcagacttccttgaatggc

SEQ ID NO: 27943 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
ctcttcctcagacttccttg

SEQ ID NO: 27944 - DNA, 20 bp, Artificial Sequence
  Description of Artificial Sequence: Synthetic oligonucleotide
  Target: ATXN1; (-) strand; PAM type: NNNNGHTT; PAM sequence: TAGAGTTT
ggggatagcttcaagtcttc

SEQ ID NO: 27945 - DNA, 20 bp, Artificial Sequence
  Description of Artificial Sequence: Synthetic oligonucleotide
  Target: ATXN1; (-) strand; PAM type: NNNNGHTT; PAM sequence: GATAGCTT
ttccatccaagtgcactggg

SEQ ID NO: 27946 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
aatgctcctgcagattgacc

SEQ ID NO: 27947 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
atccttgcttgtaatgctcc

SEQ ID NO: 27948 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
caatctcctttttcttaaat

SEQ ID NO: 27949 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
taagagggtcaggagagaag

SEQ ID NO: 27950 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
gtgtctgtcagtttgtacct

SEQ ID NO: 27951 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
gggaatttccctctgtgtct

SEQ ID NO: 27952 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
cttttgaggacagcaataat

SEQ ID NO: 27953 - DNA, 20 bp, Artificial Sequence
  Description of Artificial Sequence: Synthetic oligonucleotide
  Target: ATXN1; (-) strand; PAM type: NNNNGHTT; PAM sequence: GTTAGCTT
cttagggaggcattgtgcta

SEQ ID NO: 27954 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
gtgtgtgatgggaagttcac

SEQ ID NO: 27955 - DNA, 20 bp, Artificial Sequence
  Description of Artificial Sequence: Synthetic oligonucleotide
  Target: ATXN1; (-) strand; PAM type: NNNNGHTT; PAM sequence: CACTGCTT
ttatcatcacatcatttcat

SEQ ID NO: 27956 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
cctggctttctgtgaacggc

SEQ ID NO: 27957 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
cttgtttgtgagcatcctgc

SEQ ID NO: 27958 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
tttgagtggtttgctttgtc

SEQ ID NO: 27959 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
tctccttttccatttgagtg

SEQ ID NO: 27960 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
ttcctctccttttccatttg

SEQ ID NO: 27961 - DNA, 20 bp, Artificial Sequence
  Description of Artificial Sequence: Synthetic oligonucleotide
  Target: ATXN1; (-) strand; PAM type: NNNNGHTT; PAM sequence: TGGGGATT
ctagacctatcagtagagtt

SEQ ID NO: 27962 - DNA, 20 bp, Artificial Sequence
  Description of Artificial Sequence: Synthetic oligonucleotide
  Target: ATXN1; (-) strand; PAM type: NNNNGHTT; PAM sequence: TAGAGTTT
aaaaattctagacctatcag

SEQ ID NO: 27963 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
tgagaatgcttgaatctgat

SEQ ID NO: 27964 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
catacatgctgttctgatga

SEQ ID NO: 27965 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
tgaatgaatagtacctaaaa

SEQ ID NO: 27966 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
cctctcagtcctctagcctt

SEQ ID NO: 27967 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
catatttcattcctaagctt

SEQ ID NO: 27968 - DNA, 20 bp, Artificial Sequence
  Description of Artificial Sequence: Synthetic oligonucleotide
  Target: ATXN1; (-) strand; PAM type: NNNNGHTT; PAM sequence: CTAAGCTT
aagtgatccatatttcattc

SEQ ID NO: 27969 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
aacaggaacgatttttgaac

SEQ ID NO: 27970 - DNA, 20 bp, Artificial Sequence
  Description of Artificial Sequence: Synthetic oligonucleotide
  Target: ATXN1; (-) strand; PAM type: NNNNGHTT; PAM sequence: GAACGATT
gtccttttgaaaataaacag

SEQ ID NO: 27971 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
tgtccttagactatagcttt

SEQ ID NO: 27972 - DNA, 20 bp, Artificial Sequence
  Description of Artificial Sequence: Synthetic oligonucleotide
  Target: ATXN1; (-) strand; PAM type: NNNNGHTT; PAM sequence: TATAGCTT
atttgagactgtccttagac

SEQ ID NO: 27973 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
tttggcactacctcatttac

SEQ ID NO: 27974 - DNA, 20 bp, Artificial Sequence
  Description of Artificial Sequence: Synthetic oligonucleotide
  Target: ATXN1; (-) strand; PAM type: NNNNGHTT; PAM sequence: CAATGATT
cttcttgggttcctaaaaat

SEQ ID NO: 27975 - DNA, 20 bp, Artificial Sequence
  Description of Artificial Sequence: Synthetic oligonucleotide
  Target: ATXN1; (-) strand; PAM type: NNNNGHTT; PAM sequence: GAACGTTT
agccttagatgaggccaatt

SEQ ID NO: 27976 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
tgagttaaatcacctccagt

SEQ ID NO: 27977 - DNA, 20 bp, Artificial Sequence
  Description of Artificial Sequence: Synthetic oligonucleotide
  Target: ATXN1; (-) strand; PAM type: NNNNGHTT; PAM sequence: CCTGGATT
ctgaactcagagttagcaga

SEQ ID NO: 27978 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
cagatggcctttgcccctga

SEQ ID NO: 27979 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
gcaggcaattttcaaagaat

SEQ ID NO: 27980 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
aacactggttttctgtcttc

SEQ ID NO: 27981 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
tctgggcacatgtttacaac

SEQ ID NO: 27982 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
taacctttcattatctgggc

SEQ ID NO: 27983 - DNA, 20 bp, Artificial Sequence
  Description of Artificial Sequence: Synthetic oligonucleotide
  Target: ATXN1; (-) strand; PAM type: NNNNGHTT; PAM sequence: CCTAGTTT
ggtaggggcagtggggggtt

SEQ ID NO: 27984 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
tactttcttttcaaaaccgc

SEQ ID NO: 27985 - DNA, 20 bp, Artificial Sequence
  Description of Artificial Sequence: Synthetic oligonucleotide
  Target: ATXN1; (-) strand; PAM type: NNNNGHTT; PAM sequence: TGAGGTTT
gtcagacctcaaagattgag

SEQ ID NO: 27986 - DNA, 20 bp, Artificial Sequence
  Description of Artificial Sequence: Synthetic oligonucleotide
  Target: ATXN1; (-) strand; PAM type: NNNNGHTT; PAM sequence: CAAAGATT
tgtgacaccctgtcagacct

SEQ ID NO: 27987 - DNA, 20 bp, Artificial Sequence
  Description of Artificial Sequence: Synthetic oligonucleotide
  Target: ATXN1; (-) strand; PAM type: NNNNGHTT; PAM sequence: CGTTGCTT
ttttttgttgttgttttaac

SEQ ID NO: 27988 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
atctagtgggggttttttgt

SEQ ID NO: 27989 - DNA, 20 bp, Artificial Sequence
  Description of Artificial Sequence: Synthetic oligonucleotide
  Target: ATXN1; (-) strand; PAM type: NNNNGHTT; PAM sequence: GGGGGTTT
gcttttgtttcaaatctagt

SEQ ID NO: 27990 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gttaccataatcaagatagc

SEQ ID NO: 27991 - DNA, 20 bp, Artificial Sequence
  Description of Artificial Sequence: Synthetic oligonucleotide
  Target: ATXN1; (-) strand; PAM type: NNNNGHTT; PAM sequence: GATAGCTT
catgcagttaccataatcaa

SEQ ID NO: 27992 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
gtgtcttatgtaaaactgct

SEQ ID NO: 27993 - DNA, 20 bp, Artificial Sequence
  Description of Artificial Sequence: Synthetic oligonucleotide
  Target: ATXN1; (-) strand; PAM type: NNNNGHTT; PAM sequence: AACTGCTT
gaaacaagtgtcttatgtaa

SEQ ID NO: 27994 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
atttgggtactccagttaca

SEQ ID NO: 27995 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
aaggaataattgtgggccat

SEQ ID NO: 27996 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
tttaaaaaaaaccttattgt

SEQ ID NO: 27997 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
ttttattaagcaatcagcat

SEQ ID NO: 27998 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
cgcctctgcttcccaaaatg

SEQ ID NO: 27999 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
cctcccgcctctgcttccca

SEQ ID NO: 28000 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
agctcaagtgatcctcccgc

SEQ ID NO: 28001 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
ttttgtatttttggtagaga

SEQ ID NO: 28002 - DNA, 20 bp, Artificial Sequence
  Description of Artificial Sequence: Synthetic oligonucleotide
  Target: ATXN1; (-) strand; PAM type: NNNNGHTT; PAM sequence: TCTCGATT
gctggagtgcaatggcaaga

SEQ ID NO: 28003 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
caatattttgcaagtctgtg

SEQ ID NO: 28004 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
tgggagacactgaagcttca

SEQ ID NO: 28005 - DNA, 20 bp, Artificial Sequence
  Description of Artificial Sequence: Synthetic oligonucleotide
  Target: ATXN1; (-) strand; PAM type: NNNNGHTT; PAM sequence: TGAAGCTT
aagcagacagtgggagacac

SEQ ID NO: 28006 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
ttattaaattcaaattttcc

SEQ ID NO: 28007 - DNA, 20 bp, Artificial Sequence
  Description of Artificial Sequence: Synthetic oligonucleotide
  Target: ATXN1; (-) strand; PAM type: NNNNGHTT; PAM sequence: ATGAGCTT
aaataatcagtaatattaat

SEQ ID NO: 28008 - DNA, 20 bp, Artificial Sequence
  Description of Artificial Sequence: Synthetic oligonucleotide
  Target: ATXN1; (-) strand; PAM type: NNNNGHTT; PAM sequence: CATAGATT
gttcctaatttttttggttt

SEQ ID NO: 28009 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
aaaaaaatgttcctaatttt

SEQ ID NO: 28010 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
tattttttttgcagttgcct

SEQ ID NO: 28011 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
cacacatatatatttaggtt

SEQ ID NO: 28012 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
acacacacacacatatatat

SEQ ID NO: 28013 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tctgtaatatatatgtatac

SEQ ID NO: 28014 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
aatttcttctaggtttttgt

SEQ ID NO: 28015 - DNA, 20 bp, Artificial Sequence
  Description of Artificial Sequence: Synthetic oligonucleotide
  Target: ATXN1; (-) strand; PAM type: NNNNGHTT; PAM sequence: CTAGGTTT
aaatgacaagccaatttctt

SEQ ID NO: 28016 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
ctgtgtcacaaaacacagtt

SEQ ID NO: 28017 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
cctgatggccgccttgcatg

SEQ ID NO: 28018 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
gcttgggattttgagattag

SEQ ID NO: 28019 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
tcagttactggcttgggatt

SEQ ID NO: 28020 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
ggttttgatcagttactggc

SEQ ID NO: 28021 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
tttactggttttgatcagtt

SEQ ID NO: 28022 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
tacttaaaatgagctgattt

SEQ ID NO: 28023 - DNA, 20 bp, Artificial Sequence
  Description of Artificial Sequence: Synthetic oligonucleotide
  Target: ATXN1; (-) strand; PAM type: NNNNGHTT; PAM sequence: AGCTGATT
tgcttcccttacttaaaatg

SEQ ID NO: 28024 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
aagttacaagcagttatgtt

SEQ ID NO: 28025 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
ggtatgcaagttacaagcag

SEQ ID NO: 28026 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
atgaaaatgacatttttctc

SEQ ID NO: 28027 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
ccaggctaaggattagcaat

SEQ ID NO: 28028 - DNA, 20 bp, Artificial Sequence
  Description of Artificial Sequence: Synthetic oligonucleotide
  Target: ATXN1; (-) strand; PAM type: NNNNGHTT; PAM sequence: TAAGGATT
gggggtaaaattctccaggc

SEQ ID NO: 28029 - DNA, 20 bp, Artificial Sequence
  Description of Artificial Sequence: Synthetic oligonucleotide
  Target: ATXN1; (-) strand; PAM type: NNNNGHTT; PAM sequence: ATCAGATT
tactggtacagtcaaatagt

SEQ ID NO: 28030 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
aggaataaaaggatggaata

SEQ ID NO: 28031 - DNA, 20 bp, Artificial Sequence
  Description of Artificial Sequence: Synthetic oligonucleotide
  Target: ATXN1; (-) strand; PAM type: NNNNGHTT; PAM sequence: CTCGGCTT
ttgctggaacttgcctttct

SEQ ID NO: 28032 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
taattttttaagggaagagg

SEQ ID NO: 28033 - DNA, 20 bp, Artificial Sequence
  Description of Artificial Sequence: Synthetic oligonucleotide
  Target: ATXN1; (-) strand; PAM type: NNNNGHTT; PAM sequence: GTAGGATT
tatgtgtagtggcttgcctt

SEQ ID NO: 28034 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
caaccaagaacaatatgtgt

SEQ ID NO: 28035 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
agataacaagtgatttgatg

SEQ ID NO: 28036 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
actgtatttgttcagataac

SEQ ID NO: 28037 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
tgtgtctgaagtctcccaga

SEQ ID NO: 28038 - DNA, 20 bp, Artificial Sequence
  Description of Artificial Sequence: Synthetic oligonucleotide
  Target: ATXN1; (-) strand; PAM type: NNNNGHTT; PAM sequence: CTAAGATT
tttgcaagtttgcatctcag

SEQ ID NO: 28039 - DNA, 20 bp, Artificial Sequence
  Description of Artificial Sequence: Synthetic oligonucleotide
  Target: ATXN1; (-) strand; PAM type: NNNNGHTT; PAM sequence: GCAAGTTT
tggcctgttttgaggctttt

SEQ ID NO: 28040 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
taaagccaagtggcctgttt

SEQ ID NO: 28041 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
cagaagagtaaagccaagtg

SEQ ID NO: 28042 - DNA, 20 bp, Artificial Sequence
  Description of Artificial Sequence: Synthetic oligonucleotide
  Target: ATXN1; (-) strand; PAM type: NNNNGHTT; PAM sequence: GTGTGCTT
gatttcttctcgggaactgt

SEQ ID NO: 28043 - DNA, 20 bp, Artificial Sequence
  Description of Artificial Sequence: Synthetic oligonucleotide
  Target: ATXN1; (-) strand; PAM type: NNNNGHTT; PAM sequence: AGTGGATT
acaacgctttgcattaacat

SEQ ID NO: 28044 - DNA, 20 bp, Artificial Sequence
  Description of Artificial Sequence: Synthetic oligonucleotide
  Target: ATXN1; (-) strand; PAM type: NNNNGHTT; PAM sequence: CAACGCTT
aacaggcttatgaccaccaa

SEQ ID NO: 28045 - DNA, 20 bp, Artificial Sequence
  Description of Artificial Sequence: Synthetic oligonucleotide
  Target: ATXN1; (-) strand; PAM type: NNNNGHTT; PAM sequence: ACAGGCTT
tctggctccagagctcagga

SEQ ID NO: 28046 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
atgattggtgccttaccagt

SEQ ID NO: 28047 - DNA, 20 bp, Artificial Sequence
  Description of Artificial Sequence: Synthetic oligonucleotide
  Target: ATXN1; (-) strand; PAM type: NNNNGHTT; PAM sequence: TGATGATT
ttggatgctcccgggatagt

SEQ ID NO: 28048 - DNA, 20 bp, Artificial Sequence
  Description of Artificial Sequence: Synthetic oligonucleotide
  Target: ATXN1; (-) strand; PAM type: NNNNGHTT; PAM sequence: AGACGTTT
ctcagcacagtagggcatgc

SEQ ID NO: 28049 - DNA, 20 bp, Artificial Sequence
  Description of Artificial Sequence: Synthetic oligonucleotide
  Target: ATXN1; (-) strand; PAM type: NNNNGHTT; PAM sequence: CTTCGTTT
tttcccggagattccagatt

SEQ ID NO: 28050 - DNA, 20 bp, Artificial Sequence
  Description of Artificial Sequence: Synthetic oligonucleotide
  Target: ATXN1; (-) strand; PAM type: NNNNGHTT; PAM sequence: TCCAGATT
actttctttttcccggagat

SEQ ID NO: 28051 - DNA, 20 bp, Artificial Sequence
  Description of Artificial Sequence: Synthetic oligonucleotide
  Target: ATXN1; (-) strand; PAM type: NNNNGHTT; PAM sequence: CGGAGATT
tgccttcactttctttttcc

SEQ ID NO: 28052 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
gcccaccttacactctttct

SEQ ID NO: 28053 - DNA, 20 bp, Artificial Sequence
  Description of Artificial Sequence: Synthetic oligonucleotide
  Target: ATXN1; (-) strand; PAM type: NNNNGHTT; PAM sequence: GTGTGCTT
tacaagttcctttgcctcaa

SEQ ID NO: 28054 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
attctagtgtagcacttaaa

SEQ ID NO: 28055 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
gatgatgtatttgggaagca

SEQ ID NO: 28056 - DNA, 20 bp, Artificial Sequence
  Description of Artificial Sequence: Synthetic oligonucleotide
  Target: ATXN1; (-) strand; PAM type: NNNNGHTT; PAM sequence: TCATGATT
actgttttttctgtgcatgc

SEQ ID NO: 28057 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
acccacaatgctaatactac

SEQ ID NO: 28058 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
agagataaaggaccactctt

SEQ ID NO: 28059 - DNA, 20 bp, Artificial Sequence
  Description of Artificial Sequence: Synthetic oligonucleotide
  Target: ATXN1; (-) strand; PAM type: NNNNGHTT; PAM sequence: CTAAGATT
gtgtgttaccaattccaaat

SEQ ID NO: 28060 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
caagtaaaattgtatcaagc

SEQ ID NO: 28061 - DNA, 20 bp, Artificial Sequence
  Description of Artificial Sequence: Synthetic oligonucleotide
  Target: ATXN1; (-) strand; PAM type: NNNNGHTT; PAM sequence: GGTGGATT
cccagttgaacacagagcct

SEQ ID NO: 28062 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gggtgcagggtcctgggcta

SEQ ID NO: 28063 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
tttttccttcatattgccta

SEQ ID NO: 28064 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
tttgactttcctgttcgaat

SEQ ID NO: 28065 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
agatcagttcgtataataca

SEQ ID NO: 28066 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
tggcatgcaggtgtcaacaa

SEQ ID NO: 28067 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
gttttcagtcctttttgggg

SEQ ID NO: 28068 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
agaagtctacaagtaatgtg

SEQ ID NO: 28069 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
tacctgatccaaggtcctaa

SEQ ID NO: 28070 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
ctgttaacggtgggcataaa

SEQ ID NO: 28071 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
ctgcttttaatttctttgca

SEQ ID NO: 28072 - DNA, 20 bp, Artificial Sequence
  Description of Artificial Sequence: Synthetic oligonucleotide
  Target: ATXN1; (-) strand; PAM type: NNNNGHTT; PAM sequence: CACTGCTT
tcagatgaacatgacatttc

SEQ ID NO: 28073 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
gtaggatgaagaaagcaaac

SEQ ID NO: 28074 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
acatgaatgagcctgttgga

SEQ ID NO: 28075 - DNA, 20 bp, Artificial Sequence
  Description of Artificial Sequence: Synthetic oligonucleotide
  Target: ATXN1; (-) strand; PAM type: NNNNGHTT; PAM sequence: ACAGGCTT
gtttggcatatttgtttcag

SEQ ID NO: 28076 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
ctcaaatagaagtttggcat

SEQ ID NO: 28077 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
aaatggaaagagactcaaat

SEQ ID NO: 28078 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
ttaatatttttgtttgtata

SEQ ID NO: 28079 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
atgtggaatattgttaatat

SEQ ID NO: 28080 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
caaagttgccaggtcaaagt

SEQ ID NO: 28081 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
ttggacaccttggcttcagg

SEQ ID NO: 28082 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
gatggcaagatattggacac

SEQ ID NO: 28083 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
tggcaaggtttctttcatca

SEQ ID NO: 28084 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
gttgcaaaagaagggcatgg

SEQ ID NO: 28085 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
agtaagggttaagtcctaga

SEQ ID NO: 28086 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
cttaaagcatagctgtagac

SEQ ID NO: 28087 - DNA, 20 bp, Artificial Sequence
  Description of Artificial Sequence: Synthetic oligonucleotide
  Target: ATXN1; (-) strand; PAM type: NNNNGHTT; PAM sequence: ATGGGCTT
ggaagacagagaaaggtgaa

SEQ ID NO: 28088 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
aagttgtaatttaatttttt

SEQ ID NO: 28089 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
ccactaatgacttaagatgt

SEQ ID NO: 28090 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
tgctggtgatgaggaaatgg

SEQ ID NO: 28091 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
gccatgaaggtttccttaat

SEQ ID NO: 28092 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
atctcccctccacatgccat

SEQ ID NO: 28093 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
cagccatttctgatgctgct

SEQ ID NO: 28094 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
ccttctccagccatttctga

SEQ ID NO: 28095 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaaagtg

SEQ ID NO: 28096 - DNA, 20 bp, Artificial Sequence
  Description of Artificial Sequence: Synthetic oligonucleotide
  Target: ATXN1; (-) strand; PAM type: NNNNGHTT; PAM sequence: ATTCGTTT
aagaccctctagccatttct

SEQ ID NO: 28097 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
tacagatgggtcttagcatt

SEQ ID NO: 28098 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
ctttcaatgtagctatcaaa

SEQ ID NO: 28099 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
tctttgaaatagacaggtat

SEQ ID NO: 28100 - DNA, 20 bp, Artificial Sequence
  Description of Artificial Sequence: Synthetic oligonucleotide
  Target: ATXN1; (-) strand; PAM type: NNNNGHTT; PAM sequence: TGTCGCTT
tttttttttttttggtcatt

SEQ ID NO: 28101 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
aagttttttgttgtttggtt

SEQ ID NO: 28102 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
gtgtgtgaagttttttgttg

SEQ ID NO: 28103 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
atatagtgtgtgaagttttt

SEQ ID NO: 28104 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
aacctgggtaatatagtgtg

SEQ ID NO: 28105 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
tctggaaccagtaggaggag

SEQ ID NO: 28106 - DNA, 20 bp, Artificial Sequence
  Description of Artificial Sequence: Synthetic oligonucleotide
  Target: ATXN1; (-) strand; PAM type: NNNNGHTT; PAM sequence: GTATGCTT
ttaggaatagcagtgactga

SEQ ID NO: 28107 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
tggcattgaatgtatagtac

SEQ ID NO: 28108 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
aagtggtggaaatcaagctc

SEQ ID NO: 28109 - DNA, 20 bp, Artificial Sequence
  Description of Artificial Sequence: Synthetic oligonucleotide
  Target: ATXN1; (-) strand; PAM type: NNNNGHTT; PAM sequence: TTACGATT
gtggctggagggttgttgta

SEQ ID NO: 28110 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
tagtctgagagaggcctttg

SEQ ID NO: 28111 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
ccaggtagtctgagagaggc

SEQ ID NO: 28112 - DNA, 20 bp, Artificial Sequence
  Description of Artificial Sequence: Synthetic oligonucleotide
  Target: ATXN1; (-) strand; PAM type: NNNNGHTT; PAM sequence: GTGGGCTT
ctgggaagcttccttctcca

SEQ ID NO: 28113 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
ttcagcttttctctgtactg

SEQ ID NO: 28114 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
aggactcagattttctgtct

SEQ ID NO: 28115 - DNA, 20 bp, Artificial Sequence
  Description of Artificial Sequence: Synthetic oligonucleotide
  Target: ATXN1; (-) strand; PAM type: NNNNGHTT; PAM sequence: CTCAGATT
ggactttactgtcatcagga

SEQ ID NO: 28116 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
tcgggaggctgagtcaggag

SEQ ID NO: 28117 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
gaggcagaggttgcagtgag

SEQ ID NO: 28118 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
tcaggaggctgagacaggag

SEQ ID NO: 28119 - DNA, 20 bp, Artificial Sequence
  Description of Artificial Sequence: Synthetic oligonucleotide
  Target: ATXN1; (-) strand; PAM type: NNNNGHTT; PAM sequence: CCTTGATT
atcccttcacaacagcagaa

SEQ ID NO: 28120 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
agctcacatggttttttgta

SEQ ID NO: 28121 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
atggtcctttttcaagctca

SEQ ID NO: 28122 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
gcttagctgaattatctgtt

SEQ ID NO: 28123 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
ttggaggtccgaagtccagg

SEQ ID NO: 28124 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
ctggaggtgcgaagtccagg

SEQ ID NO: 28125 - DNA, 20 bp, Artificial Sequence
  Description of Artificial Sequence: Synthetic oligonucleotide
  Target: ATXN1; (-) strand; PAM type: NNNNGHTT; PAM sequence: CACAGTTT
acaatacctatttattatct

SEQ ID NO: 28126 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
tatgttattattattatact

SEQ ID NO: 28127 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
atgtattgtattatatgtgg

SEQ ID NO: 28128 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
aagaaatgtattgtattata

SEQ ID NO: 28129 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
caatagacaaattaaactca

SEQ ID NO: 28130 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
atctcagagaaattaagaat

SEQ ID NO: 28131 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
ggagataccagggaccagga

SEQ ID NO: 28132 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgtttccactgcatatatcc

SEQ ID NO: 28133 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
gaaagtttgaaataaacata

SEQ ID NO: 28134 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
ggtttggagcaagggactgg

SEQ ID NO: 28135 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
cagaaattaaagaggaggag

SEQ ID NO: 28136 - DNA, 20 bp, Artificial Sequence
  Description of Artificial Sequence: Synthetic oligonucleotide
  Target: ATXN1; (-) strand; PAM type: NNNNGHTT; PAM sequence: GTCAGCTT
gagtagaagatgatgatgct

SEQ ID NO: 28137 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
gatccaacagggatgactca

SEQ ID NO: 28138 - DNA, 20 bp, Artificial Sequence
  Description of Artificial Sequence: Synthetic oligonucleotide
  Target: ATXN1; (-) strand; PAM type: NNNNGHTT; PAM sequence: GCCAGATT
agttggaaaagcatgctggg

SEQ ID NO: 28139 - DNA, 20 bp, Artificial Sequence
  Description of Artificial Sequence: Synthetic oligonucleotide
  Target: ATXN1; (-) strand; PAM type: NNNNGHTT; PAM sequence: GGCTGCTT
ggaagtgagaagctcactgt

SEQ ID NO: 28140 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
tttgagctggtcttgggagg

SEQ ID NO: 28141 - DNA, 20 bp, Artificial Sequence
  Description of Artificial Sequence: Synthetic oligonucleotide
  Target: ATXN1; (-) strand; PAM type: NNNNGHTT; PAM sequence: GTGGGATT
ataaaagagttgtagaaaaa

SEQ ID NO: 28142 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
aaaaaaaaaaaaaaaaaaac

SEQ ID NO: 28143 - DNA, 20 bp, Artificial Sequence
  Description of Artificial Sequence: Synthetic oligonucleotide
  Target: ATXN1; (-) strand; PAM type: NNNNGHTT; PAM sequence: TGAAGCTT
tatcatttgcgaaagccccg

SEQ ID NO: 28144 - DNA, 20 bp, Artificial Sequence
  Description of Artificial Sequence: Synthetic oligonucleotide
  Target: ATXN1; (-) strand; PAM type: NNNNGHTT; PAM sequence: TGATGATT
agtttccttagagacttatg

SEQ ID NO: 28145 - DNA, 20 bp, Artificial Sequence
  Description of Artificial Sequence: Synthetic oligonucleotide
  Target: ATXN1; (-) strand; PAM type: NNNNGHTT; PAM sequence: CACAGTTT
aacatttcattgagggactg

SEQ ID NO: 28146 - DNA, 20 bp, Artificial Sequence
  Description of Artificial Sequence: Synthetic oligonucleotide
  Target: ATXN1; (-) strand; PAM type: NNNNGHTT; PAM sequence: GGCAGCTT
ctgcaattgccagcagccct

SEQ ID NO: 28147 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
tgggaaaggggtgtttttgg

SEQ ID NO: 28148 - DNA, 20 bp, Artificial Sequence
  Description of Artificial Sequence: Synthetic oligonucleotide
  Target: ATXN1; (-) strand; PAM type: NNNNGHTT; PAM sequence: GGGTGTTT
gatgcctctccatgggaaag

SEQ ID NO: 28149 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
atcatattcttcagaatacc

SEQ ID NO: 28150 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
atgctaggtatccaaggact

SEQ ID NO: 28151 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
ttctttaggccggtactaat

SEQ ID NO: 28152 - DNA, 20 bp, Artificial Sequence
  Description of Artificial Sequence: Synthetic oligonucleotide
  Target: ATXN1; (-) strand; PAM type: NNNNGHTT; PAM sequence: CACAGATT
gtcgttctacagctgctcag

SEQ ID NO: 28153 - DNA, 20 bp, Artificial Sequence
  Description of Artificial Sequence: Synthetic oligonucleotide
  Target: ATXN1; (-) strand; PAM type: NNNNGHTT; PAM sequence: CTGGGCTT
taactcgggatgtggagtct

SEQ ID NO: 28154 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
atcaaagcatgaggcacagg

SEQ ID NO: 28155 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
cttagctgctcatgatttat

SEQ ID NO: 28156 - DNA, 20 bp, Artificial Sequence
  Description of Artificial Sequence: Synthetic oligonucleotide
  Target: ATXN1; (-) strand; PAM type: NNNNGHTT; PAM sequence: TCATGATT
atcttgcagaccttagctgc

SEQ ID NO: 28157 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
aatatttagctatttctttt

SEQ ID NO: 28158 - DNA, 20 bp, Artificial Sequence
  Description of Artificial Sequence: Synthetic oligonucleotide
  Target: ATXN1; (-) strand; PAM type: NNNNGHTT; PAM sequence: CCCCGTTT
ctcttcattttatcttcact

SEQ ID NO: 28159 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
cagaggttgggagatgcata

SEQ ID NO: 28160 - DNA, 20 bp, Artificial Sequence
  Description of Artificial Sequence: Synthetic oligonucleotide
  Target: ATXN1; (-) strand; PAM type: NNNNGHTT; PAM sequence: TCGTGTTT
ttgataggatgcttccaagg

SEQ ID NO: 28161 - DNA, 20 bp, Artificial Sequence
  Description of Artificial Sequence: Synthetic oligonucleotide
  Target: ATXN1; (-) strand; PAM type: NNNNGHTT; PAM sequence: GGATGCTT
aggaagttgtggctttgata

SEQ ID NO: 28162 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
tcataaaaagaaaaggaagt

SEQ ID NO: 28163 - DNA, 20 bp, Artificial Sequence
  Description of Artificial Sequence: Synthetic oligonucleotide
  Target: ATXN1; (-) strand; PAM type: NNNNGHTT; PAM sequence: GCATGATT
cccaatactaattttttaaa

SEQ ID NO: 28164 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
tgccttggcctcccaaagta

SEQ ID NO: 28165 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtatttttagtagaga

SEQ ID NO: 28166 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctccgcttcctgggttc

SEQ ID NO: 28167 - DNA, 20 bp, Artificial Sequence
  Description of Artificial Sequence: Synthetic oligonucleotide
  Target: ATXN1; (-) strand; PAM type: NNNNGHTT; PAM sequence: CTCCGCTT
tgatctcggctcactgcaac

SEQ ID NO: 28168 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
tctgttgtttttgagctttg

SEQ ID NO: 28169 - DNA, 20 bp, Artificial Sequence
  Description of Artificial Sequence: Synthetic oligonucleotide
  Target: ATXN1; (-) strand; PAM type: NNNNGHTT; PAM sequence: TTGAGCTT
agaaaataattctgttgttt

SEQ ID NO: 28170 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
tgaatttcagaaaataattc

SEQ ID NO: 28171 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
gcaaaagtagttaaatctgg

SEQ ID NO: 28172 - DNA, 20 bp, Artificial Sequence
  Description of Artificial Sequence: Synthetic oligonucleotide
  Target: ATXN1; (-) strand; PAM type: NNNNGHTT; PAM sequence: GTTGGCTT
agtatggagttgttgtatct

SEQ ID NO: 28173 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
actcggaatagtattaaaaa

SEQ ID NO: 28174 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
ctttgtcttgcaatactttg

SEQ ID NO: 28175 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
gaagcctcctccaaaaaaag

SEQ ID NO: 28176 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
gaaatcccagttttaagcta

SEQ ID NO: 28177 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
acagttaagaccattgaaat

SEQ ID NO: 28178 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
catcaaagtatacctgtctt

SEQ ID NO: 28179 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
tcacactcagcacccctctc

SEQ ID NO: 28180 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
gcgatcatcaggtattttaa

SEQ ID NO: 28181 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
catggtgtaaagaaattcct

SEQ ID NO: 28182 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
catagatgatgctaattcta

SEQ ID NO: 28183 - DNA, 20 bp, Artificial Sequence
  Description of Artificial Sequence: Synthetic oligonucleotide
  Target: ATXN1; (-) strand; PAM type: NNNNGHTT; PAM sequence: GAGAGATT
caaaacaattaagcagtgaa

SEQ ID NO: 28184 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
ggtaacaaaaatgaactttt

SEQ ID NO: 28185 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
agtcattcccgggagaattc

SEQ ID NO: 28186 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
ttacatcagtcttattatga

SEQ ID NO: 28187 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
ttctttttacatcagtctta

SEQ ID NO: 28188 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
tttggataatggatagtctg

SEQ ID NO: 28189 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
tgctgttactagcagagtta

SEQ ID NO: 28190 - DNA, 20 bp, Artificial Sequence
  Description of Artificial Sequence: Synthetic oligonucleotide
  Target: ATXN1; (-) strand; PAM type: NNNNGHTT; PAM sequence: AGGCGATT
cggcgtttcccagcaggcac

SEQ ID NO: 28191 - DNA, 20 bp, Artificial Sequence
  Description of Artificial Sequence: Synthetic oligonucleotide
  Target: ATXN1; (-) strand; PAM type: NNNNGHTT; PAM sequence: CGGCGTTT
aacagatggaggaacttgca

SEQ ID NO: 28192 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
tccttactagaagggcattc

SEQ ID NO: 28193 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
aggtctgtgttaactcaaac

SEQ ID NO: 28194 - DNA, 20 bp, Artificial Sequence
  Description of Artificial Sequence: Synthetic oligonucleotide
  Target: ATXN1; (-) strand; PAM type: NNNNGHTT; PAM sequence: TCCAGATT
ccagcccttccattcatcac

SEQ ID NO: 28195 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
gtgattccattttcatctta

SEQ ID NO: 28196 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
taaaccagtcattttaccct

SEQ ID NO: 28197 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
aaaacagttaaaatgctgaa

SEQ ID NO: 28198 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
aggagtgggggacagggagt

SEQ ID NO: 28199 - DNA, 20 bp, Artificial Sequence
  Description of Artificial Sequence: Synthetic oligonucleotide
  Target: ATXN1; (-) strand; PAM type: NNNNGHTT; PAM sequence: AGTAGATT
acaactccttagagtcagaa

SEQ ID NO: 28200 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
aaaggccacatattgtatga

SEQ ID NO: 28201 - DNA, 20 bp, Artificial Sequence
  Description of Artificial Sequence: Synthetic oligonucleotide
  Target: ATXN1; (-) strand; PAM type: NNNNGHTT; PAM sequence: GTATGATT
gacacaaaaggccacatatt

SEQ ID NO: 28202 - DNA, 20 bp, Artificial Sequence
  Description of Artificial Sequence: Synthetic oligonucleotide
  Target: ATXN1; (-) strand; PAM type: NNNNGHTT; PAM sequence: GCATGATT
gtacatgaatgttcatagca

SEQ ID NO: 28203 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
ctgctcttaggtatacactg

SEQ ID NO: 28204 - DNA, 20 bp, Artificial Sequence
  Description of Artificial Sequence: Synthetic oligonucleotide
  Target: ATXN1; (-) strand; PAM type: NNNNGHTT; PAM sequence: GCAAGCTT
aaggaaaataacaagtgttg

SEQ ID NO: 28205 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
gaaaagatgtccaacatcat

SEQ ID NO: 28206 - DNA, 20 bp, Artificial Sequence
  Description of Artificial Sequence: Synthetic oligonucleotide
  Target: ATXN1; (-) strand; PAM type: NNNNGHTT; PAM sequence: ATAAGCTT
agaagatatataaatagcca

SEQ ID NO: 28207 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
agatggacaaaggcattgga

SEQ ID NO: 28208 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
aaagagaaaaagactaacaa

SEQ ID NO: 28209 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
aagtcagtatctcataaggg

SEQ ID NO: 28210 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
ttcatgaccatggatttggc

SEQ ID NO: 28211 - DNA, 20 bp, Artificial Sequence
  Description of Artificial Sequence: Synthetic oligonucleotide
  Target: ATXN1; (-) strand; PAM type: NNNNGHTT; PAM sequence: CATGGATT
caggagtaaatcttcatgac

SEQ ID NO: 28212 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
aataatgtatatttttaaag

SEQ ID NO: 28213 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
tttaaaataatgtatatttt

SEQ ID NO: 28214 - DNA, 20 bp, Artificial Sequence
  Description of Artificial Sequence: Synthetic oligonucleotide
  Target: ATXN1; (-) strand; PAM type: NNNNGHTT; PAM sequence: GTTGGCTT
aagcaccacctcaagaggtg

SEQ ID NO: 28215 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
agtcagcaatttcaagctac

SEQ ID NO: 28216 - DNA, 20 bp, Artificial Sequence
  Description of Artificial Sequence: Synthetic oligonucleotide
  Target: ATXN1; (-) strand; PAM type: NNNNGHTT; PAM sequence: TCGGGCTT
ccaatcttaatgggtgggtg

SEQ ID NO: 28217 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
atttggcatgaattagttta

SEQ ID NO: 28218 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
ttatacacgatttggcatga

SEQ ID NO: 28219 - DNA, 20 bp, Artificial Sequence
  Description of Artificial Sequence: Synthetic oligonucleotide
  Target: ATXN1; (-) strand; PAM type: NNNNGHTT; PAM sequence: ACACGATT
ctattatttctcttggttat

SEQ ID NO: 28220 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tacaacctacactgtattct

SEQ ID NO: 28221 - DNA, 20 bp, Artificial Sequence
  Description of Artificial Sequence: Synthetic oligonucleotide
  Target: ATXN1; (-) strand; PAM type: NNNNGHTT; PAM sequence: GGGGGATT
gttggagaactgatgcttta

SEQ ID NO: 28222 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
gtgtagccaagttggagaac

SEQ ID NO: 28223 - DNA, 20 bp, Artificial Sequence
  Description of Artificial Sequence: Synthetic oligonucleotide
  Target: ATXN1; (-) strand; PAM type: NNNNGHTT; PAM sequence: GGGAGCTT
ctgcatagtagaatcacttg

SEQ ID NO: 28224 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
tcatgtaaatgtacatccct

SEQ ID NO: 28225 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
atacaagaaattcaagtttt

SEQ ID NO: 28226 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
tgataactgatacaagaaat

SEQ ID NO: 28227 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
cgcttaattaatctctcaga

SEQ ID NO: 28228 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
ctgtcgcttaattaatctct

SEQ ID NO: 28229 - DNA, 20 bp, Artificial Sequence
  Description of Artificial Sequence: Synthetic oligonucleotide
  Target: ATXN1; (-) strand; PAM type: NNNNGHTT; PAM sequence: TGTCGCTT
caagttctgtgatctagggc

SEQ ID NO: 28230 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
ttggcccttttgaaattact

SEQ ID NO: 28231 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
taccttcttgtagttgggcc

SEQ ID NO: 28232 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
gaatgaattggtagtttcct

SEQ ID NO: 28233 - DNA, 20 bp, Artificial Sequence
  Description of Artificial Sequence: Synthetic oligonucleotide
  Target: ATXN1; (-) strand; PAM type: NNNNGHTT; PAM sequence: GGTAGTTT
aatccataaatgaatgaatt

SEQ ID NO: 28234 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
gtcttgtcactcactactga

SEQ ID NO: 28235 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
tcttcagtcttgtcactcac

SEQ ID NO: 28236 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
gaacctgaatatttaagtat

SEQ ID NO: 28237 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
ttaataatacattttaccaa

SEQ ID NO: 28238 - DNA, 20 bp, Artificial Sequence
  Description of Artificial Sequence: Synthetic oligonucleotide
  Target: ATXN1; (-) strand; PAM type: NNNNGHTT; PAM sequence: ACCAGTTT
aaacctacacatttgagtgc

SEQ ID NO: 28239 - DNA, 20 bp, Artificial Sequence
  Description of Artificial Sequence: Synthetic oligonucleotide
  Target: ATXN1; (-) strand; PAM type: NNNNGHTT; PAM sequence: GTGTGATT
agtcttcactcaagccttgt

SEQ ID NO: 28240 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
taacatgacaaccctccttt

SEQ ID NO: 28241 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
ttttaaaaataaagaattct

SEQ ID NO: 28242 - DNA, 20 bp, Artificial Sequence
  Description of Artificial Sequence: Synthetic oligonucleotide
  Target: ATXN1; (-) strand; PAM type: NNNNGHTT; PAM sequence: AGGGGCTT
ggacaaatacctaatgcatg

SEQ ID NO: 28243 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
ttataaagacacatgcacac

SEQ ID NO: 28244 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
ccgttactggttatataccc

SEQ ID NO: 28245 - DNA, 20 bp, Artificial Sequence
  Description of Artificial Sequence: Synthetic oligonucleotide
  Target: ATXN1; (-) strand; PAM type: NNNNGHTT; PAM sequence: TGGCGATT
aaccattgtggaagacagtg

SEQ ID NO: 28246 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
gcgaggctgtggagaaatag

SEQ ID NO: 28247 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
aatctattgtatagaattct

SEQ ID NO: 28248 - DNA, 20 bp, Artificial Sequence
  Description of Artificial Sequence: Synthetic oligonucleotide
  Target: ATXN1; (-) strand; PAM type: NNNNGHTT; PAM sequence: GACAGATT
gatacactgaaaagaaagtt

SEQ ID NO: 28249 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
agcaattcagagcatactga

SEQ ID NO: 28250 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
cctgaaatgtggttgaagat

SEQ ID NO: 28251 - DNA, 20 bp, Artificial Sequence
  Description of Artificial Sequence: Synthetic oligonucleotide
  Target: ATXN1; (-) strand; PAM type: NNNNGHTT; PAM sequence: GATAGATT
aatgaaactttgcaaattta

SEQ ID NO: 28252 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
tttctgcacaaatcattttc

SEQ ID NO: 28253 - DNA, 20 bp, Artificial Sequence
  Description of Artificial Sequence: Synthetic oligonucleotide
  Target: ATXN1; (-) strand; PAM type: NNNNGHTT; PAM sequence: AACAGCTT
ttttcaatttgtttaaatgc

SEQ ID NO: 28254 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
cagaatcctactgtttttca

SEQ ID NO: 28255 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
acggtctatagccagaatcc

SEQ ID NO: 28256 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
aaaatgatattctgggcaag

SEQ ID NO: 28257 - DNA, 20 bp, Artificial Sequence
  Description of Artificial Sequence: Synthetic oligonucleotide
  Target: ATXN1; (-) strand; PAM type: NNNNGHTT; PAM sequence: GCAAGTTT
tgcttaaaatgatattctgg

SEQ ID NO: 28258 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
tagcagttaattgtattttt

SEQ ID NO: 28259 - DNA, 20 bp, Artificial Sequence
  Description of Artificial Sequence: Synthetic oligonucleotide
  Target: ATXN1; (-) strand; PAM type: NNNNGHTT; PAM sequence: GTAGGATT
tgacaattccgattctgtat

SEQ ID NO: 28260 - DNA, 20 bp, Artificial Sequence
  Description of Artificial Sequence: Synthetic oligonucleotide
  Target: ATXN1; (-) strand; PAM type: NNNNGHTT; PAM sequence: TTCCGATT
gctttggacctggttgacaa

SEQ ID NO: 28261 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
agacatcaggttttataatt

SEQ ID NO: 28262 - DNA, 20 bp, Artificial Sequence
  Description of Artificial Sequence: Synthetic oligonucleotide
  Target: ATXN1; (-) strand; PAM type: NNNNGHTT; PAM sequence: TCAGGTTT
tcttgtctatttctgagaca

SEQ ID NO: 28263 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
gactgtaataattatttttt

SEQ ID NO: 28264 - DNA, 20 bp, Artificial Sequence
  Description of Artificial Sequence: Synthetic oligonucleotide
  Target: ATXN1; (-) strand; PAM type: NNNNGHTT; PAM sequence: GTGCGATT
ttattctcacttttctttgt

SEQ ID NO: 28265 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
tcaatgaaatgttcagtggg

SEQ ID NO: 28266 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
atagttggtgacgattagct

SEQ ID NO: 28267 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
aattattatagttggtgacg

SEQ ID NO: 28268 - DNA, 20 bp, Artificial Sequence
  Description of Artificial Sequence: Synthetic oligonucleotide
  Target: ATXN1; (-) strand; PAM type: NNNNGHTT; PAM sequence: TGACGATT
taaaaaattattatagttgg

SEQ ID NO: 28269 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
attttgtttgaaggcagagt

SEQ ID NO: 28270 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tattagatttctatataaga

SEQ ID NO: 28271 - DNA, 20 bp, Artificial Sequence
  Description of Artificial Sequence: Synthetic oligonucleotide
  Target: ATXN1; (-) strand; PAM type: NNNNGHTT; PAM sequence: ATAAGATT
cttgtgtattagatttctat

SEQ ID NO: 28272 - DNA, 20 bp, Artificial Sequence
  Description of Artificial Sequence: Synthetic oligonucleotide
  Target: ATXN1; (-) strand; PAM type: NNNNGHTT; PAM sequence: ATTAGATT
caattttatttatcttgtgt

SEQ ID NO: 28273 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
gaccacattctccagtagcc

SEQ ID NO: 28274 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
tgtgcttgtgttactctgag

SEQ ID NO: 28275 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
tataactatgaatacatttt

SEQ ID NO: 28276 - DNA, 20 bp, Artificial Sequence
  Description of Artificial Sequence: Synthetic oligonucleotide
  Target: ATXN1; (-) strand; PAM type: NNNNGHTT; PAM sequence: CCTAGTTT
tatttacataaatatttttc

SEQ ID NO: 28277 - DNA, 20 bp, Artificial Sequence
  Description of Artificial Sequence: Synthetic oligonucleotide
  Target: ATXN1; (-) strand; PAM type: NNNNGHTT; PAM sequence: TGTAGTTT
gatggtacattttatatttg

SEQ ID NO: 28278 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
gccactgactgtatagttaa

SEQ ID NO: 28279 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
agtttcagttttgcaaaatg

SEQ ID NO: 28280 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
atgtacgtatgttaaaaagt

SEQ ID NO: 28281 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
ttttaaatgtacgtatgtta

SEQ ID NO: 28282 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tagtagctaagctagtaggc

SEQ ID NO: 28283 - DNA, 20 bp, Artificial Sequence
  Description of Artificial Sequence: Synthetic oligonucleotide
  Target: ATXN1; (-) strand; PAM type: NNNNGHTT; PAM sequence: GAGGGCTT
acatgcgagtaggagtcagt

SEQ ID NO: 28284 - DNA, 20 bp, Artificial Sequence
  Description of Artificial Sequence: Synthetic oligonucleotide
  Target: ATXN1; (-) strand; PAM type: NNNNGHTT; PAM sequence: GCATGCTT
caggccctgttctttacaag

SEQ ID NO: 28285 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
agctatgtgtgttgtataca

SEQ ID NO: 28286 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
tatgcactgtagattaaatg

SEQ ID NO: 28287 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
gataatatgcactgtagatt

SEQ ID NO: 28288 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
tcactgatgataatatgcac

SEQ ID NO: 28289 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
atgaaatagataccagtttt

SEQ ID NO: 28290 - DNA, 20 bp, Artificial Sequence
  Description of Artificial Sequence: Synthetic oligonucleotide
  Target: ATXN1; (-) strand; PAM type: NNNNGHTT; PAM sequence: ACCAGTTT
tgtgcaaatatgaaatagat

SEQ ID NO: 28291 - DNA, 20 bp, Artificial Sequence
  Description of Artificial Sequence: Synthetic oligonucleotide
  Target: ATXN1; (-) strand; PAM type: NNNNGHTT; PAM sequence: AAACGATT
tgaaaaacatttaaaattaa

SEQ ID NO: 28292 - DNA, 20 bp, Artificial Sequence
  Description of Artificial Sequence: Synthetic oligonucleotide
  Target: ATXN1; (-) strand; PAM type: NNNNGHTT; PAM sequence: GTGAGATT
tgctttttgcttctccaagt

SEQ ID NO: 28293 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
agtccttttccttctttgct

SEQ ID NO: 28294 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
cttttcaagtccttttcctt

SEQ ID NO: 28295 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
cacgtcaggaacagcttaac

SEQ ID NO: 28296 - DNA, 20 bp, Artificial Sequence
  Description of Artificial Sequence: Synthetic oligonucleotide
  Target: ATXN1; (-) strand; PAM type: NNNNGHTT; PAM sequence: AACAGCTT
ggtgcaggaagcacgtcagg

SEQ ID NO: 28297 - DNA, 20 bp, Artificial Sequence
  Description of Artificial Sequence: Synthetic oligonucleotide
  Target: ATXN1; (-) strand; PAM type: NNNNGHTT; PAM sequence: AGCTGATT
aaaaaaaaaggaaacaggag

SEQ ID NO: 28298 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
taagcagggattgtgtccag

SEQ ID NO: 28299 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
ccacagctgagagggataag

SEQ ID NO: 28300 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
cttctttcaggcaaggactg

SEQ ID NO: 28301 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
ggttgagatttgggctgccg

SEQ ID NO: 28302 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
ttgcctgttagtgaagaagg

SEQ ID NO: 28303 - DNA, 20 bp, Artificial Sequence
  Description of Artificial Sequence: Synthetic oligonucleotide
  Target: ATXN1; (-) strand; PAM type: NNNNGHTT; PAM sequence: GTAAGCTT
ctggttaaattcaacacatg

SEQ ID NO: 28304 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
ttctgagtaacagaaagtct

SEQ ID NO: 28305 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
ctaataagggacctttttca

SEQ ID NO: 28306 - DNA, 20 bp, Artificial Sequence
  Description of Artificial Sequence: Synthetic oligonucleotide
  Target: ATXN1; (-) strand; PAM type: NNNNGHTT; PAM sequence: TAAGGTTT
tctttcccttattaactttt

SEQ ID NO: 28307 - DNA, 20 bp, Artificial Sequence
  Description of Artificial Sequence: Synthetic oligonucleotide
  Target: ATXN1; (-) strand; PAM type: NNNNGHTT; PAM sequence: ATGCGTTT
accttccatataaagcttat

SEQ ID NO: 28308 - DNA, 20 bp, Artificial Sequence
  Description of Artificial Sequence: Synthetic oligonucleotide
  Target: ATXN1; (-) strand; PAM type: NNNNGHTT; PAM sequence: TAAAGCTT
agtgcacttaaccttccata

SEQ ID NO: 28309 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
aagactgcttttccagcaag

SEQ ID NO: 28310 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
aggttgttttaaggaacaaa

SEQ ID NO: 28311 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
tccataagtagtcaattgca

SEQ ID NO: 28312 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
atcttattactgagacccta

SEQ ID NO: 28313 - DNA, 20 bp, Artificial Sequence
  Description of Artificial Sequence: Synthetic oligonucleotide
  Target: ATXN1; (-) strand; PAM type: NNNNGHTT; PAM sequence: AGTAGTTT
tgtttaaaagatagacgcat

SEQ ID NO: 28314 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
aagcaacactaaaattactt

SEQ ID NO: 28315 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
ggaggcttttatgagaaagc

SEQ ID NO: 28316 - DNA, 20 bp, Artificial Sequence
  Description of Artificial Sequence: Synthetic oligonucleotide
  Target: ATXN1; (-) strand; PAM type: NNNNGHTT; PAM sequence: GGAGGCTT
tcgccattcgttgggtatat

SEQ ID NO: 28317 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
atgggaggaaatgggacacg

SEQ ID NO: 28318 - DNA, 20 bp, Artificial Sequence
  Description of Artificial Sequence: Synthetic oligonucleotide
  Target: ATXN1; (-) strand; PAM type: NNNNGHTT; PAM sequence: AGAGGATT
tgaaaaggagaatcacaaaa

SEQ ID NO: 28319 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
gcttatagtaagccctgatg

SEQ ID NO: 28320 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
gatcttccattcctgtttaa

SEQ ID NO: 28321 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
ggcttccaatgatcttccat

SEQ ID NO: 28322 - DNA, 20 bp, Artificial Sequence
  Description of Artificial Sequence: Synthetic oligonucleotide
  Target: ATXN1; (-) strand; PAM type: NNNNGHTT; PAM sequence: CAGGGCTT
agaaatattttctatttttc

SEQ ID NO: 28323 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
accactttcttcatttgact

SEQ ID NO: 28324 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
gaggtcagaggagacatcag

SEQ ID NO: 28325 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
agggggaggtcagaggagac

SEQ ID NO: 28326 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
attcatcatgtaaatggatt

SEQ ID NO: 28327 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
atcattgaattcatcatgta

SEQ ID NO: 28328 - DNA, 20 bp, Artificial Sequence
  Description of Artificial Sequence: Synthetic oligonucleotide
  Target: ATXN1; (-) strand; PAM type: NNNNGHTT; PAM sequence: GAGTGATT
tctttgacctgggaattgca

SEQ ID NO: 28329 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cttgctgcaaagttataagc

SEQ ID NO: 28330 - DNA, 20 bp, Artificial Sequence
  Description of Artificial Sequence: Synthetic oligonucleotide
  Target: ATXN1; (-) strand; PAM type: NNNNGHTT; PAM sequence: ATAAGCTT
tcccctcttgctgcaaagtt

SEQ ID NO: 28331 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
ggtaaaaggtagtactgaaa

SEQ ID NO: 28332 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
gtacatacatccctacatcc

SEQ ID NO: 28333 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
ctaaggcttaaagcatgatg

SEQ ID NO: 28334 - DNA, 20 bp, Artificial Sequence
  Description of Artificial Sequence: Synthetic oligonucleotide
  Target: ATXN1; (-) strand; PAM type: NNNNGHTT; PAM sequence: TAAGGCTT
aattgaaatccatcatattc

SEQ ID NO: 28335 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
taacaacagatattaaacca

SEQ ID NO: 28336 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
tattagaaaatctttatttt

SEQ ID NO: 28337 - DNA, 20 bp, Artificial Sequence
  Description of Artificial Sequence: Synthetic oligonucleotide
  Target: ATXN1; (-) strand; PAM type: NNNNGHTT; PAM sequence: GAACGTTT
gtctttcctagaggcatgag

SEQ ID NO: 28338 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
tgattgagcccattgctcat

SEQ ID NO: 28339 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
aaagcccttaaacactaata

SEQ ID NO: 28340 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
ttggagacttcagtcaaaga

SEQ ID NO: 28341 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
gcatacataataattgtaaa

SEQ ID NO: 28342 - DNA, 20 bp, Artificial Sequence
  Description of Artificial Sequence: Synthetic oligonucleotide
  Target: ATXN1; (-) strand; PAM type: NNNNGHTT; PAM sequence: GAGGGCTT
aagggtacttaggcttttct

SEQ ID NO: 28343 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
aactcaaaaattaagggtac

SEQ ID NO: 28344 - DNA, 20 bp, Artificial Sequence
  Description of Artificial Sequence: Synthetic oligonucleotide
  Target: ATXN1; (-) strand; PAM type: NNNNGHTT; PAM sequence: GGTAGTTT
gccaaactagcatttatcaa

SEQ ID NO: 28345 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
caagaataattactagtcaa

SEQ ID NO: 28346 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
tttttatttatagtgacatc

SEQ ID NO: 28347 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
gcttttaaaagtaatcttta

SEQ ID NO: 28348 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
tgcaacttaaccacttactg

SEQ ID NO: 28349 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
tcctaaaccatattattaag

SEQ ID NO: 28350 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
catcttgacgttcatctact

SEQ ID NO: 28351 - DNA, 20 bp, Artificial Sequence
  Description of Artificial Sequence: Synthetic oligonucleotide
  Target: ATXN1; (-) strand; PAM type: NNNNGHTT; PAM sequence: TATCGTTT
ctacatggcaggtcatgtag

SEQ ID NO: 28352 - DNA, 20 bp, Artificial Sequence
  Description of Artificial Sequence: Synthetic oligonucleotide
  Target: ATXN1; (-) strand; PAM type: NNNNGHTT; PAM sequence: TCACGTTT
ctactatatcagtatcttcc

SEQ ID NO: 28353 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
tatatacattaatttagaca

SEQ ID NO: 28354 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
tttctattaaaccatcagat

SEQ ID NO: 28355 - DNA, 20 bp, Artificial Sequence
  Description of Artificial Sequence: Synthetic oligonucleotide
  Target: ATXN1; (-) strand; PAM type: NNNNGHTT; PAM sequence: ATCAGATT
ttagagatttctattaaacc

SEQ ID NO: 28356 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
tctataagcatttaaggatt

SEQ ID NO: 28357 - DNA, 20 bp, Artificial Sequence
  Description of Artificial Sequence: Synthetic oligonucleotide
  Target: ATXN1; (-) strand; PAM type: NNNNGHTT; PAM sequence: TAAGGATT
ccagtttgtctataagcatt

SEQ ID NO: 28358 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
tcctttcaatgaattttttg

SEQ ID NO: 28359 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
agtagccatcctaataggtt

SEQ ID NO: 28360 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
taccaacagtgcacaagggt

SEQ ID NO: 28361 - DNA, 20 bp, Artificial Sequence
  Description of Artificial Sequence: Synthetic oligonucleotide
  Target: ATXN1; (-) strand; PAM type: NNNNGHTT; PAM sequence: TATCGTTT
aaattttttatgaactgctg

SEQ ID NO: 28362 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
catctgtccataaacacttg

SEQ ID NO: 28363 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ccactcttgtatatatcaca

SEQ ID NO: 28364 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gggtttgtccttttgtgact

SEQ ID NO: 28365 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ctcctatgagtagaatcaca

SEQ ID NO: 28366 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
ctcgttgtgcatccagtctc

SEQ ID NO: 28367 - DNA, 20 bp, Artificial Sequence
  Description of Artificial Sequence: Synthetic oligonucleotide
  Target: ATXN1; (-) strand; PAM type: NNNNGHTT; PAM sequence: TTGGGCTT
ggatagaaaatgacagtggc

SEQ ID NO: 28368 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
ttgacaggatagaaaatgac

SEQ ID NO: 28369 - DNA, 20 bp, Artificial Sequence
  Description of Artificial Sequence: Synthetic oligonucleotide
  Target: ATXN1; (-) strand; PAM type: NNNNGHTT; PAM sequence: CCCTGCTT
atagtatgccggtcttctta

SEQ ID NO: 28370 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
gacagtcagaatgagctatc

SEQ ID NO: 28371 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
agaaggtgtccaggggctgt

SEQ ID NO: 28372 - DNA, 20 bp, Artificial Sequence
  Description of Artificial Sequence: Synthetic oligonucleotide
  Target: ATXN1; (-) strand; PAM type: NNNNGHTT; PAM sequence: GCATGATT
agtagtagataggacagata

SEQ ID NO: 28373 - DNA, 20 bp, Artificial Sequence
  Description of Artificial Sequence: Synthetic oligonucleotide
  Target: ATXN1; (-) strand; PAM type: NNNNGHTT; PAM sequence: GAAAGATT
aagattgaaactgcagttta

SEQ ID NO: 28374 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
acgagaaagaagattgaaac

SEQ ID NO: 28375 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
aagagattttgaaacgagaa

SEQ ID NO: 28376 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
agcgaagaggaaccagcaac

SEQ ID NO: 28377 - DNA, 20 bp, Artificial Sequence
  Description of Artificial Sequence: Synthetic oligonucleotide
  Target: ATXN1; (-) strand; PAM type: NNNNGHTT; PAM sequence: CGCAGATT
agggccattgagaccagaga

SEQ ID NO: 28378 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
aatgggattttagtttgcaa

SEQ ID NO: 28379 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
aggtgatttgggaatgggat

SEQ ID NO: 28380 - DNA, 20 bp, Artificial Sequence
  Description of Artificial Sequence: Synthetic oligonucleotide
  Target: ATXN1; (-) strand; PAM type: NNNNGHTT; PAM sequence: ATGGGATT
acagagaaggtgatttggga

SEQ ID NO: 28381 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
caggccaatttccacagaga

SEQ ID NO: 28382 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
ttaaagatagaagtgatcac

SEQ ID NO: 28383 - DNA, 20 bp, Artificial Sequence
  Description of Artificial Sequence: Synthetic oligonucleotide
  Target: ATXN1; (-) strand; PAM type: NNNNGHTT; PAM sequence: ACACGCTT
aactgtatataaaagtaaaa

SEQ ID NO: 28384 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
atgcagaagacagaagccat

SEQ ID NO: 28385 - DNA, 20 bp, Artificial Sequence
  Description of Artificial Sequence: Synthetic oligonucleotide
  Target: ATXN1; (-) strand; PAM type: NNNNGHTT; PAM sequence: GTGAGCTT
gtatgagatgagtggctgct

SEQ ID NO: 28386 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
gttatgtttggtttctccta

SEQ ID NO: 28387 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
aatgagttatgtaagttatg

SEQ ID NO: 28388 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
ctttgaatgagttatgtaag

SEQ ID NO: 28389 - DNA, 20 bp, Artificial Sequence
  Description of Artificial Sequence: Synthetic oligonucleotide
  Target: ATXN1; (-) strand; PAM type: NNNNGHTT; PAM sequence: CCTAGTTT
tataagccactgtgcctggc

SEQ ID NO: 28390 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
ggtcttgaactcctggactc

SEQ ID NO: 28391 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttggtagaga

SEQ ID NO: 28392 - DNA, 20 bp, Artificial Sequence
  Description of Artificial Sequence: Synthetic oligonucleotide
  Target: ATXN1; (-) strand; PAM type: NNNNGHTT; PAM sequence: AGTAGCTT
cctcccaccttagcctccca

SEQ ID NO: 28393 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
gaaggttggtaaaattaacc

SEQ ID NO: 28394 - DNA, 20 bp, Artificial Sequence
  Description of Artificial Sequence: Synthetic oligonucleotide
  Target: ATXN1; (-) strand; PAM type: NNNNGHTT; PAM sequence: ACAAGCTT
gacttcccacccttaaatag

SEQ ID NO: 28395 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
ggagaagtgtactattggca

SEQ ID NO: 28396 - DNA, 20 bp, Artificial Sequence
  Description of Artificial Sequence: Synthetic oligonucleotide
  Target: ATXN1; (-) strand; PAM type: NNNNGHTT; PAM sequence: AACCGATT
atgcacatattttcacagcc

SEQ ID NO: 28397 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
cacgtgggaaaaaaaaaatc

SEQ ID NO: 28398 - DNA, 20 bp, Artificial Sequence
  Description of Artificial Sequence: Synthetic oligonucleotide
  Target: ATXN1; (-) strand; PAM type: NNNNGHTT; PAM sequence: CTAAGATT
atcaagtctgtattttctta

SEQ ID NO: 28399 - DNA, 20 bp, Artificial Sequence
  Description of Artificial Sequence: Synthetic oligonucleotide
  Target: ATXN1; (-) strand; PAM type: NNNNGHTT; PAM sequence: CCCAGCTT
gccctctaagcaggactttc

SEQ ID NO: 28400 - DNA, 20 bp, Artificial Sequence
  Description of Artificial Sequence: Synthetic oligonucleotide
  Target: ATXN1; (-) strand; PAM type: NNNNGHTT; PAM sequence: GGATGATT
tgtttgaatcctggaaatca

SEQ ID NO: 28401 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
taattcccatgcatggtgtc

SEQ ID NO: 28402 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
ctattgtgttaaaacataaa

SEQ ID NO: 28403 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
agtcctggagctagcatggc

SEQ ID NO: 28404 - DNA, 20 bp, Artificial Sequence
  Description of Artificial Sequence: Synthetic oligonucleotide
  Target: ATXN1; (-) strand; PAM type: NNNNGHTT; PAM sequence: GGTTGATT
aggtttcggacttgttgcta

SEQ ID NO: 28405 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
tacaggtatgagaagttttt

SEQ ID NO: 28406 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
gtgctaggattacaggtatg

SEQ ID NO: 28407 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
cactttggcttcccaaagtg

SEQ ID NO: 28408 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
ggctcaagcaatcctctcac

SEQ ID NO: 28409 - DNA, 20 bp, Artificial Sequence
  Description of Artificial Sequence: Synthetic oligonucleotide
  Target: ATXN1; (-) strand; PAM type: NNNNGHTT; PAM sequence: GGAAGTTT
agcaggctggagaagttttt

SEQ ID NO: 28410 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
atttttagcaagcaggctgg

SEQ ID NO: 28411 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
cccagcctcgcttatcttcc

SEQ ID NO: 28412 - DNA, 20 bp, Artificial Sequence
  Description of Artificial Sequence: Synthetic oligonucleotide
  Target: ATXN1; (-) strand; PAM type: NNNNGHTT; PAM sequence: CCTCGCTT
ttgtcttcagtcttccccag

SEQ ID NO: 28413 - DNA, 20 bp, Artificial Sequence
  Description of Artificial Sequence: Synthetic oligonucleotide
  Target: ATXN1; (-) strand; PAM type: NNNNGHTT; PAM sequence: ATAAGCTT
gcaaggttagtcttgccatt

SEQ ID NO: 28414 - DNA, 20 bp, Artificial Sequence
  Description of Artificial Sequence: Synthetic oligonucleotide
  Target: ATXN1; (-) strand; PAM type: NNNNGHTT; PAM sequence: GACCGTTT
gtatgtacaaagattagagg

SEQ ID NO: 28415 - DNA, 20 bp, Artificial Sequence
  Description of Artificial Sequence: Synthetic oligonucleotide
  Target: ATXN1; (-) strand; PAM type: NNNNGHTT; PAM sequence: CAAAGATT
attgaacccatgagtatgta

SEQ ID NO: 28416 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
ggtggcagaacttctgagga

SEQ ID NO: 28417 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
tttacggatactcaaacaaa

SEQ ID NO: 28418 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
tgaggggtgatttgagatgt

SEQ ID NO: 28419 - DNA, 20 bp, Artificial Sequence
  Description of Artificial Sequence: Synthetic oligonucleotide
  Target: ATXN1; (-) strand; PAM type: NNNNGHTT; PAM sequence: GGGTGATT
ttactcttcttagagctgag

SEQ ID NO: 28420 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
aacagtaaacacagcaatga

SEQ ID NO: 28421 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
tgcttagaacttggagatgc

SEQ ID NO: 28422 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
taaaagagaataccttttat

SEQ ID NO: 28423 - DNA, 20 bp, Artificial Sequence
  Description of Artificial Sequence: Synthetic oligonucleotide
  Target: ATXN1; (-) strand; PAM type: NNNNGHTT; PAM sequence: AACCGATT
tctatttctcttcacttttt

SEQ ID NO: 28424 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
acttgcaggagggagggaat

SEQ ID NO: 28425 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
actaacaaattcctagaaag

SEQ ID NO: 28426 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
tagaaagccttctgtttcaa

SEQ ID NO: 28427 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
gatattttacttagaaagcc

SEQ ID NO: 28428 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
ccgttggctgaacttttgaa

SEQ ID NO: 28429 - DNA, 20 bp, Artificial Sequence
  Description of Artificial Sequence: Synthetic oligonucleotide
  Target: ATXN1; (-) strand; PAM type: NNNNGHTT; PAM sequence: AAGGGATT
gattagttctgttggcgtag

SEQ ID NO: 28430 - DNA, 20 bp, Artificial Sequence
  Description of Artificial Sequence: Synthetic oligonucleotide
  Target: ATXN1; (-) strand; PAM type: NNNNGHTT; PAM sequence: ATGAGATT
aggagctgaaaaatgcatac

SEQ ID NO: 28431 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
taatgaagataaacatgttg

SEQ ID NO: 28432 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
atattgtttgaaaggacatt

SEQ ID NO: 28433 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
gtgatctctgccctgttgta

SEQ ID NO: 28434 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
gtcagctaaccaaagaatct

SEQ ID NO: 28435 - DNA, 20 bp, Artificial Sequence
  Description of Artificial Sequence: Synthetic oligonucleotide
  Target: ATXN1; (-) strand; PAM type: NNNNGHTT; PAM sequence: GCAGGCTT
gtgtagaaactcaagcacga

SEQ ID NO: 28436 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
atgttctgttccccatttcc

SEQ ID NO: 28437 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
aacagacagcctaagctatt

SEQ ID NO: 28438 - DNA, 20 bp, Artificial Sequence
  Description of Artificial Sequence: Synthetic oligonucleotide
  Target: ATXN1; (-) strand; PAM type: NNNNGHTT; PAM sequence: GTAAGATT
cctgttagattgatttgtga

SEQ ID NO: 28439 - DNA, 20 bp, Artificial Sequence
  Description of Artificial Sequence: Synthetic oligonucleotide
  Target: ATXN1; (-) strand; PAM type: NNNNGHTT; PAM sequence: GATTGATT
aatatcaccgtggcctgtta

SEQ ID NO: 28440 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
ccataatatcaccgtggcct

SEQ ID NO: 28441 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
cagcaaggcataggacccca

SEQ ID NO: 28442 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
acctgagttgctgctcttga

SEQ ID NO: 28443 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
tacccttgctggtcagaacc

SEQ ID NO: 28444 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
caggaagtgtgacagaacag

SEQ ID NO: 28445 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
tcttgcctttcttgtctgct

SEQ ID NO: 28446 - DNA, 20 bp, Artificial Sequence
  Description of Artificial Sequence: Synthetic oligonucleotide
  Target: ATXN1; (-) strand; PAM type: NNNNGHTT; PAM sequence: GTCTGCTT
cctgacatcttgcctttctt

SEQ ID NO: 28447 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
agagtgagctcctgagctcc

SEQ ID NO: 28448 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
tgagagacgctacggctgtg

SEQ ID NO: 28449 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
atgtattgattgcattcccg

SEQ ID NO: 28450 - DNA, 20 bp, Artificial Sequence
  Description of Artificial Sequence: Synthetic oligonucleotide
  Target: ATXN1; (-) strand; PAM type: NNNNGHTT; PAM sequence: TCCCGTTT
gaggcatgtattgattgcat

SEQ ID NO: 28451 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
gatgggcgagaggaggcatg

SEQ ID NO: 28452 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
ttgggagaaaggaggaagaa

SEQ ID NO: 28453 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
atccaacaagagggagtcag

SEQ ID NO: 28454 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
ttgtgatccaacaagaggga

SEQ ID NO: 28455 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cttgcaagctgacagtcttt

SEQ ID NO: 28456 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
tggccctctagtggagataa

SEQ ID NO: 28457 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
tccttcgagccctccctccc

SEQ ID NO: 28458 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
agagagcctgtggcagaacc

SEQ ID NO: 28459 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttagtagaga

SEQ ID NO: 28460 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaagtag

SEQ ID NO: 28461 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctctgcctcccgggttc

SEQ ID NO: 28462 - DNA, 20 bp, Artificial Sequence
  Description of Artificial Sequence: Synthetic oligonucleotide
  Target: ATXN1; (-) strand; PAM type: NNNNGHTT; PAM sequence: TAAGGTTT
cagttgcaggcgtaaggaga

SEQ ID NO: 28463 - DNA, 20 bp, Artificial Sequence
  Description of Artificial Sequence: Synthetic oligonucleotide
  Target: ATXN1; (-) strand; PAM type: NNNNGHTT; PAM sequence: ATGAGCTT
aagaaccatgttttagtgag

SEQ ID NO: 28464 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
caagttggggatgtgaagaa

SEQ ID NO: 28465 - DNA, 20 bp, Artificial Sequence
  Description of Artificial Sequence: Synthetic oligonucleotide
  Target: ATXN1; (-) strand; PAM type: NNNNGHTT; PAM sequence: TGGAGATT
aactgggggttggcagtcac

SEQ ID NO: 28466 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
cacggtgcttcttgttggtt

SEQ ID NO: 28467 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
cccaggacacggtgcttctt

SEQ ID NO: 28468 - DNA, 20 bp, Artificial Sequence
  Description of Artificial Sequence: Synthetic oligonucleotide
  Target: ATXN1; (-) strand; PAM type: NNNNGHTT; PAM sequence: CGGTGCTT
actgacagattcccaggaca

SEQ ID NO: 28469 - DNA, 20 bp, Artificial Sequence
  Description of Artificial Sequence: Synthetic oligonucleotide
  Target: ATXN1; (-) strand; PAM type: NNNNGHTT; PAM sequence: GACAGATT
aggactgagtcccagccact

SEQ ID NO: 28470 - DNA, 20 bp, Artificial Sequence
  Description of Artificial Sequence: Synthetic oligonucleotide
  Target: ATXN1; (-) strand; PAM type: NNNNGHTT; PAM sequence: AGGGGCTT
tcagctccagatcaacgaag

SEQ ID NO: 28471 - DNA, 20 bp, Artificial Sequence
  Description of Artificial Sequence: Synthetic oligonucleotide
  Target: ATXN1; (-) strand; PAM type: NNNNGHTT; PAM sequence: TCATGCTT
ccctcctgcatccgcttctc

SEQ ID NO: 28472 - DNA, 20 bp, Artificial Sequence
  Description of Artificial Sequence: Synthetic oligonucleotide
  Target: ATXN1; (-) strand; PAM type: NNNNGHTT; PAM sequence: ATCCGCTT
ctataccatccccctcctgc

SEQ ID NO: 28473 - DNA, 20 bp, Artificial Sequence
  Description of Artificial Sequence: Synthetic oligonucleotide
  Target: ATXN1; (-) strand; PAM type: NNNNGHTT; PAM sequence: CCATGATT
ttaacctgtctgggatgctt

SEQ ID NO: 28474 - DNA, 20 bp, Artificial Sequence
  Description of Artificial Sequence: Synthetic oligonucleotide
  Target: ATXN1; (-) strand; PAM type: NNNNGHTT; PAM sequence: GGATGCTT
aggcaaagttaacctgtctg

SEQ ID NO: 28475 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
attaggcttgttaaaaatta

SEQ ID NO: 28476 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
cctgaatgagatggagatca

SEQ ID NO: 28477 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
tacctggcagcccccaaagc

SEQ ID NO: 28478 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
gctatgtcctaagcatggct

SEQ ID NO: 28479 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
gtcacctgctatgtcctaag

SEQ ID NO: 28480 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
gcaccagcaattcaatgctt

SEQ ID NO: 28481 - DNA, 20 bp, Artificial Sequence
  Description of Artificial Sequence: Synthetic oligonucleotide
  Target: ATXN1; (-) strand; PAM type: NNNNGHTT; PAM sequence: CAATGCTT
ggaaaattgcaccagcaatt

SEQ ID NO: 28482 - DNA, 20 bp, Artificial Sequence
  Description of Artificial Sequence: Synthetic oligonucleotide
  Target: ATXN1; (-) strand; PAM type: NNNNGHTT; PAM sequence: GTCTGCTT
atgcataactccatgatgca

SEQ ID NO: 28483 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
tttcagtagcttagcaaaat

SEQ ID NO: 28484 - DNA, 20 bp, Artificial Sequence
  Description of Artificial Sequence: Synthetic oligonucleotide
  Target: ATXN1; (-) strand; PAM type: NNNNGHTT; PAM sequence: AGTAGCTT
aaggtcaaccctaaactttc

SEQ ID NO: 28485 - DNA, 20 bp, Artificial Sequence
  Description of Artificial Sequence: Synthetic oligonucleotide
  Target: ATXN1; (-) strand; PAM type: NNNNGHTT; PAM sequence: ATAAGCTT
attgtattagtcaggatagg

SEQ ID NO: 28486 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
ctagcacaaggcattgttag

SEQ ID NO: 28487 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
tcagttatgagttaagcagc

SEQ ID NO: 28488 - DNA, 20 bp, Artificial Sequence
  Description of Artificial Sequence: Synthetic oligonucleotide
  Target: ATXN1; (-) strand; PAM type: NNNNGHTT; PAM sequence: CATAGCTT
tctcacagctagcctgactc

SEQ ID NO: 28489 - DNA, 20 bp, Artificial Sequence
  Description of Artificial Sequence: Synthetic oligonucleotide
  Target: ATXN1; (-) strand; PAM type: NNNNGHTT; PAM sequence: ACTCGTTT
ccttacaagatacattttaa

SEQ ID NO: 28490 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
agcacttacaacatgcccag

SEQ ID NO: 28491 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
ttttacccttactagattgc

SEQ ID NO: 28492 - DNA, 20 bp, Artificial Sequence
  Description of Artificial Sequence: Synthetic oligonucleotide
  Target: ATXN1; (-) strand; PAM type: NNNNGHTT; PAM sequence: ACTAGATT
tttacatatcttttaccctt

SEQ ID NO: 28493 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
ggctctgtaatacttcactt

SEQ ID NO: 28494 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
tgaatgaataaacacataga

SEQ ID NO: 28495 - DNA, 20 bp, Artificial Sequence
  Description of Artificial Sequence: Synthetic oligonucleotide
  Target: ATXN1; (-) strand; PAM type: NNNNGHTT; PAM sequence: GCTGGTTT
ttgggcttctgcatccgact

SEQ ID NO: 28496 - DNA, 20 bp, Artificial Sequence
  Description of Artificial Sequence: Synthetic oligonucleotide
  Target: ATXN1; (-) strand; PAM type: NNNNGHTT; PAM sequence: TTGGGCTT
tgttgttttcttcgtggcgc

SEQ ID NO: 28497 - DNA, 20 bp, Artificial Sequence
  Description of Artificial Sequence: Synthetic oligonucleotide
  Target: ATXN1; (-) strand; PAM type: NNNNGHTT; PAM sequence: TGGCGCTT
cttacctgttgttttcttcg

SEQ ID NO: 28498 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
ctcactcaagccttcttacc

SEQ ID NO: 28499 - DNA, 20 bp, Artificial Sequence
  Description of Artificial Sequence: Synthetic oligonucleotide
  Target: ATXN1; (-) strand; PAM type: NNNNGHTT; PAM sequence: TGGCGTTT
tagaaagctggggtggggcg

SEQ ID NO: 28500 - DNA, 20 bp, Artificial Sequence
  Description of Artificial Sequence: Synthetic oligonucleotide
  Target: ATXN1; (-) strand; PAM type: NNNNGHTT; PAM sequence: GTTGGCTT
aaggagggggcataggccac

SEQ ID NO: 28501 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
gctaaccctgctcaaaatta

SEQ ID NO: 28502 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
tggtcgcaggccacctgcag

SEQ ID NO: 28503 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
tgaggtctgtttaggggagg

SEQ ID NO: 28504 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
attcctaatttggttttgag

SEQ ID NO: 28505 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
attaggatagtgattcctaa

SEQ ID NO: 28506 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
ttaggtttgatagattagga

SEQ ID NO: 28507 - DNA, 20 bp, Artificial Sequence
  Description of Artificial Sequence: Synthetic oligonucleotide
  Target: ATXN1; (-) strand; PAM type: NNNNGHTT; PAM sequence: GATAGATT
atgacagatagattaggttt

SEQ ID NO: 28508 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
ccattaagatgacagataga

SEQ ID NO: 28509 - DNA, 20 bp, Artificial Sequence
  Description of Artificial Sequence: Synthetic oligonucleotide
  Target: ATXN1; (-) strand; PAM type: NNNNGHTT; PAM sequence: GATAGATT
atttttccattaagatgaca

SEQ ID NO: 28510 - DNA, 20 bp, Artificial Sequence
  Description of Artificial Sequence: Synthetic oligonucleotide
  Target: ATXN1; (-) strand; PAM type: NNNNGHTT; PAM sequence: GAGGGATT
gactattaagtaagagattt

SEQ ID NO: 28511 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
agcgttttggactattaagt

SEQ ID NO: 28512 - DNA, 20 bp, Artificial Sequence
  Description of Artificial Sequence: Synthetic oligonucleotide
  Target: ATXN1; (-) strand; PAM type: NNNNGHTT; PAM sequence: TAGCGTTT
tgggatcagacttctcagtc

SEQ ID NO: 28513 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
actgaccatagcatataccc

SEQ ID NO: 28514 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
gtcacaaggtaagaatatct

SEQ ID NO: 28515 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
tcaagaaattattttcctaa

SEQ ID NO: 28516 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
atatattgctttgggggcct

SEQ ID NO: 28517 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
gtatttccttttttcatata

SEQ ID NO: 28518 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
ttggggctttcacatttctc

SEQ ID NO: 28519 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
tttctctactgatgtgtggt

SEQ ID NO: 28520 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
ccagagaggcagtttctaat

SEQ ID NO: 28521 - DNA, 20 bp, Artificial Sequence
  Description of Artificial Sequence: Synthetic oligonucleotide
  Target: ATXN1; (-) strand; PAM type: NNNNGHTT; PAM sequence: GGCAGTTT
ctgggagctcttaccagaga

SEQ ID NO: 28522 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
agagtgctcatttaatatgc

SEQ ID NO: 28523 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
attgaaaggaggtggagagt

SEQ ID NO: 28524 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
ggcctgtgatatgcggagaa

SEQ ID NO: 28525 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
gggaaatgctcttgccagcg

SEQ ID NO: 28526 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
ggtcttgggaacaatgctgc

SEQ ID NO: 28527 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
gtaaaacgtgagtccctggg

SEQ ID NO: 28528 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
tgtagaccacttgtggctac

SEQ ID NO: 28529 - DNA, 20 bp, Artificial Sequence
  Description of Artificial Sequence: Synthetic oligonucleotide
  Target: ATXN1; (-) strand; PAM type: NNNNGHTT; PAM sequence: ATAGGATT
tccatttccatgcttacatc

SEQ ID NO: 28530 - DNA, 20 bp, Artificial Sequence
  Description of Artificial Sequence: Synthetic oligonucleotide
  Target: ATXN1; (-) strand; PAM type: NNNNGHTT; PAM sequence: CCATGCTT
aagtgaagaaatgtccattt

SEQ ID NO: 28531 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
gtaaaggtctctttagagtc

SEQ ID NO: 28532 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
tcttatctgagaaaagccca

SEQ ID NO: 28533 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
ttagcattcattagaactgt

SEQ ID NO: 28534 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
atggaatgtagaacatagat

SEQ ID NO: 28535 - DNA, 20 bp, Artificial Sequence
  Description of Artificial Sequence: Synthetic oligonucleotide
  Target: ATXN1; (-) strand; PAM type: NNNNGHTT; PAM sequence: CATAGATT
atactgaatggaatgtagaa

SEQ ID NO: 28536 - DNA, 20 bp, Artificial Sequence
  Description of Artificial Sequence: Synthetic oligonucleotide
  Target: ATXN1; (-) strand; PAM type: NNNNGHTT; PAM sequence: GTCAGCTT
tttattattttatccaactt

SEQ ID NO: 28537 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
caaagggtagtattaagagc

SEQ ID NO: 28538 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
agtggtcaaagggtagtatt

SEQ ID NO: 28539 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
tttagacatcctaggttaaa

SEQ ID NO: 28540 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tgtggtttgtttgtttgttt

SEQ ID NO: 28541 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tgtgtgtggtttgtttgttt

SEQ ID NO: 28542 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
actgtgtgtgtggtttgttt

SEQ ID NO: 28543 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
cttgactgtgtgtgtggttt

SEQ ID NO: 28544 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
taaacttgactgtgtgtgtg

SEQ ID NO: 28545 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
aaggtaaacttgactgtgtg

SEQ ID NO: 28546 - DNA, 20 bp, Artificial Sequence
  Description of Artificial Sequence: Synthetic oligonucleotide
  Target: ATXN1; (-) strand; PAM type: NNNNGHTT; PAM sequence: ATATGATT
aagatggagagaagttaaga

SEQ ID NO: 28547 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
ttcgttttttttaaagttat

SEQ ID NO: 28548 - DNA, 20 bp, Artificial Sequence
  Description of Artificial Sequence: Synthetic oligonucleotide
  Target: ATXN1; (-) strand; PAM type: NNNNGHTT; PAM sequence: ATTCGTTT
caccgcgcccggccccattt

SEQ ID NO: 28549 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgcctcggcctcccaaagtg

SEQ ID NO: 28550 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
tttttgtatttttagtagag

SEQ ID NO: 28551 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
aacatttattcttttatttt

SEQ ID NO: 28552 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
gtgctgagacttggtggtac

SEQ ID NO: 28553 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
ctgttatggatgtcatctga

SEQ ID NO: 28554 - DNA, 20 bp, Artificial Sequence
  Description of Artificial Sequence: Synthetic oligonucleotide
  Target: ATXN1; (-) strand; PAM type: NNNNGHTT; PAM sequence: GGTAGTTT
tttgaggctgtagagttata

SEQ ID NO: 28555 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
acaagtctggttttggaatc

SEQ ID NO: 28556 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
tgatgtttgccctgcacaag

SEQ ID NO: 28557 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
gtgtttggctcctagctgca

SEQ ID NO: 28558 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
gagctaggattttgatactg

SEQ ID NO: 28559 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
cttcatggagagtagcagag

SEQ ID NO: 28560 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
agaggctcacatcaccttta

SEQ ID NO: 28561 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
atgagcaccagatgagacct

SEQ ID NO: 28562 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
ctgtaggcaagggggaacca

SEQ ID NO: 28563 - DNA, 20 bp, Artificial Sequence
  Description of Artificial Sequence: Synthetic oligonucleotide
  Target: ATXN1; (-) strand; PAM type: NNNNGHTT; PAM sequence: GGAAGTTT
ccttgtccagctcacagaaa

SEQ ID NO: 28564 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
cgatttcttttttgccgttc

SEQ ID NO: 28565 - DNA, 20 bp, Artificial Sequence
  Description of Artificial Sequence: Synthetic oligonucleotide
  Target: ATXN1; (-) strand; PAM type: NNNNGHTT; PAM sequence: CTGCGATT
ggtttcccttgtagattttt

SEQ ID NO: 28566 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
ttggagaggatggtttccct

SEQ ID NO: 28567 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
tcactgggtcctttggagag

SEQ ID NO: 28568 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
gcatgcactctctagttttc

SEQ ID NO: 28569 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
gtgtgtgacagcatgcactc

SEQ ID NO: 28570 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
tcgtgagaaagaaatcgacg

SEQ ID NO: 28571 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
taaaaaatctttttttctat

SEQ ID NO: 28572 - DNA, 20 bp, Artificial Sequence
  Description of Artificial Sequence: Synthetic oligonucleotide
  Target: ATXN1; (-) strand; PAM type: NNNNGHTT; PAM sequence: GACTGATT
cctctaggcctgctcatttg

SEQ ID NO: 28573 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
tacatattgattgttcaaag

SEQ ID NO: 28574 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
gcctgtgattgttctctaca

SEQ ID NO: 28575 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
tcatgataaatgaatcatgc

SEQ ID NO: 28576 - DNA, 20 bp, Artificial Sequence
  Description of Artificial Sequence: Synthetic oligonucleotide
  Target: ATXN1; (-) strand; PAM type: NNNNGHTT; PAM sequence: AATTGATT
tttaagaaaggcacctaaaa

SEQ ID NO: 28577 - DNA, 20 bp, Artificial Sequence
  Description of Artificial Sequence: Synthetic oligonucleotide
  Target: ATXN1; (-) strand; PAM type: NNNNGHTT; PAM sequence: GAGCGCTT
ttgggaggctgaggtggaag

SEQ ID NO: 28578 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
tggctcagtcccctgggcct

SEQ ID NO: 28579 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
agctacttggcggctaaggc

SEQ ID NO: 28580 - DNA, 20 bp, Artificial Sequence
  Description of Artificial Sequence: Synthetic oligonucleotide
  Target: ATXN1; (-) strand; PAM type: NNNNGHTT; PAM sequence: ACGGGATT
tcagacactgtggcttcctc

SEQ ID NO: 28581 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
cccgtcagtatctcagacac

SEQ ID NO: 28582 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
catctctgttctttcccaca

SEQ ID NO: 28583 - DNA, 20 bp, Artificial Sequence
  Description of Artificial Sequence: Synthetic oligonucleotide
  Target: ATXN1; (-) strand; PAM type: NNNNGHTT; PAM sequence: TCAGGCTT
ctcccttatctccctttctt

SEQ ID NO: 28584 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
gaacttagttccttgtgtgg

SEQ ID NO: 28585 - DNA, 20 bp, Artificial Sequence
  Description of Artificial Sequence: Synthetic oligonucleotide
  Target: ATXN1; (-) strand; PAM type: NNNNGHTT; PAM sequence: TGGAGATT
ggcgtctttaaaatagtctc

SEQ ID NO: 28586 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
cacagaacatcaggagctgg

SEQ ID NO: 28587 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
tgggacttggaggagtgccc

SEQ ID NO: 28588 - DNA, 20 bp, Artificial Sequence
  Description of Artificial Sequence: Synthetic oligonucleotide
  Target: ATXN1; (-) strand; PAM type: NNNNGHTT; PAM sequence: GGCAGTTT
caatgtttgcatggctttct

SEQ ID NO: 28589 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
ctaccatttttcaatgtttg

SEQ ID NO: 28590 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
tgccagtatctaccattttt

SEQ ID NO: 28591 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
tttaaaacgaagaagatact

SEQ ID NO: 28592 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
cgtgtgagtggattataaag

SEQ ID NO: 28593 - DNA, 20 bp, Artificial Sequence
  Description of Artificial Sequence: Synthetic oligonucleotide
  Target: ATXN1; (-) strand; PAM type: NNNNGHTT; PAM sequence: AGTGGATT
tgaaaaggtcaatgcgtgtg

SEQ ID NO: 28594 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
gactgaggtctgactttgaa

SEQ ID NO: 28595 - DNA, 20 bp, Artificial Sequence
  Description of Artificial Sequence: Synthetic oligonucleotide
  Target: ATXN1; (-) strand; PAM type: NNNNGHTT; PAM sequence: GAGAGTTT
acaaatgaggaaagggttca

SEQ ID NO: 28596 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gccaaatggtgataatgcct

SEQ ID NO: 28597 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tggcttggcctcccaaagtg

SEQ ID NO: 28598 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
tcctgacttcaggtgatcca

SEQ ID NO: 28599 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttagtagaga

SEQ ID NO: 28600 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcttcccaaatag

SEQ ID NO: 28601 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
agttcaagcaattttcctgc

SEQ ID NO: 28602 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tttgttgttgttgttgttgt

SEQ ID NO: 28603 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
gtaatttttgttgttgttgt

SEQ ID NO: 28604 - DNA, 20 bp, Artificial Sequence
  Description of Artificial Sequence: Synthetic oligonucleotide
  Target: ATXN1; (-) strand; PAM type: NNNNGHTT; PAM sequence: GTGGGATT
ttttgagtatatacccagtc

SEQ ID NO: 28605 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
gtgcagatttttcctcaata

SEQ ID NO: 28606 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
gctgtaacaaacagaggaag

SEQ ID NO: 28607 - DNA, 20 bp, Artificial Sequence
  Description of Artificial Sequence: Synthetic oligonucleotide
  Target: ATXN1; (-) strand; PAM type: NNNNGHTT; PAM sequence: GATTGCTT
catctgttggtagacattta

SEQ ID NO: 28608 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
cattcatctgttggtagaca

SEQ ID NO: 28609 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
gctaagtttgtctttctgtg

SEQ ID NO: 28610 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
cacagataagtgagaacatg

SEQ ID NO: 28611 - DNA, 20 bp, Artificial Sequence
  Description of Artificial Sequence: Synthetic oligonucleotide
  Target: ATXN1; (-) strand; PAM type: NNNNGHTT; PAM sequence: GTTTGATT
tgtgtccatgagttcagtag

SEQ ID NO: 28612 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
tctctgtgtccatgagttca

SEQ ID NO: 28613 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
gtatatgtatggggtacatg

SEQ ID NO: 28614 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
tatctaattattatacagtg

SEQ ID NO: 28615 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
cttctgtggatttgtattac

SEQ ID NO: 28616 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
gtgattattagtgggacttc

SEQ ID NO: 28617 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
tcatataaccagactgttaa

SEQ ID NO: 28618 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
tatatatatatatatatata

SEQ ID NO: 28619 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
tactatcatagtacattata

SEQ ID NO: 28620 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
atacatctattgatgttaaa

SEQ ID NO: 28621 - DNA, 20 bp, Artificial Sequence
  Description of Artificial Sequence: Synthetic oligonucleotide
  Target: ATXN1; (-) strand; PAM type: NNNNGHTT; PAM sequence: TAAGGCTT
ccaaaacaactttttgctgt

SEQ ID NO: 28622 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
ctattccctgtggtatatgt

SEQ ID NO: 28623 - DNA, 20 bp, Artificial Sequence
  Description of Artificial Sequence: Synthetic oligonucleotide
  Target: ATXN1; (-) strand; PAM type: NNNNGHTT; PAM sequence: GTGTGATT
cacctactgaatattctaat

SEQ ID NO: 28624 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgccttggcctcccaaagtg

SEQ ID NO: 28625 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtatttttagtagaga

SEQ ID NO: 28626 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccgagtag

SEQ ID NO: 28627 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
gtggtgcattctcgactcac

SEQ ID NO: 28628 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
ttttttttttttttttgaga

SEQ ID NO: 28629 - DNA, 20 bp, Artificial Sequence
  Description of Artificial Sequence: Synthetic oligonucleotide
  Target: ATXN1; (-) strand; PAM type: NNNNGHTT; PAM sequence: TAGCGATT
catttgcttgacttcagact

SEQ ID NO: 28630 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
gattgggctgaaacaaggac

SEQ ID NO: 28631 - DNA, 20 bp, Artificial Sequence
  Description of Artificial Sequence: Synthetic oligonucleotide
  Target: ATXN1; (-) strand; PAM type: NNNNGHTT; PAM sequence: CCATGATT
tgtatcattaagtaactcta

SEQ ID NO: 28632 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
tctaggatcactcaagatca

SEQ ID NO: 28633 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
tttaggttttcaccttcaaa

SEQ ID NO: 28634 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
ctgatttttttttttttttt

SEQ ID NO: 28635 - DNA, 20 bp, Artificial Sequence
  Description of Artificial Sequence: Synthetic oligonucleotide
  Target: ATXN1; (-) strand; PAM type: NNNNGHTT; PAM sequence: TCCTGATT
ttctaaagaaatatggtaag

SEQ ID NO: 28636 - DNA, 20 bp, Artificial Sequence
  Description of Artificial Sequence: Synthetic oligonucleotide
  Target: ATXN1; (-) strand; PAM type: NNNNGHTT; PAM sequence: CTTAGATT
ccattctctttgagaaggaa

SEQ ID NO: 28637 - DNA, 20 bp, Artificial Sequence
  Description of Artificial Sequence: Synthetic oligonucleotide
  Target: ATXN1; (-) strand; PAM type: NNNNGHTT; PAM sequence: GTGAGATT
tccccagcctcccctcaaaa

SEQ ID NO: 28638 - DNA, 20 bp, Artificial Sequence
  Description of Artificial Sequence: Synthetic oligonucleotide
  Target: ATXN1; (-) strand; PAM type: NNNNGHTT; PAM sequence: ACACGATT
tcgtgtctccatggctggag

SEQ ID NO: 28639 - DNA, 20 bp, Artificial Sequence
  Description of Artificial Sequence: Synthetic oligonucleotide
  Target: ATXN1; (-) strand; PAM type: NNNNGHTT; PAM sequence: GCCTGATT
ctctgccagccccatctcct

SEQ ID NO: 28640 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
catctccgcctttgatctcg

SEQ ID NO: 28641 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
acctgccattggttatggac

SEQ ID NO: 28642 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
acatggtcaaaatgtaatag

SEQ ID NO: 28643 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
tctgtgttcttagttcccaa

SEQ ID NO: 28644 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
gtcctgaattgtactatgaa

SEQ ID NO: 28645 - DNA, 20 bp, Artificial Sequence
  Description of Artificial Sequence: Synthetic oligonucleotide
  Target: ATXN1; (-) strand; PAM type: NNNNGHTT; PAM sequence: AGCAGATT
aggcatgagccacagcaccc

SEQ ID NO: 28646 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgccttggcctccgaaagtg

SEQ ID NO: 28647 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
acggggttttgccatgttgc

SEQ ID NO: 28648 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttgtatttttagtagaga

SEQ ID NO: 28649 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccgagtag

SEQ ID NO: 28650 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
aacctccacctcccgggtta

SEQ ID NO: 28651 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
tttggaagcaatgtatgatt

SEQ ID NO: 28652 - DNA, 20 bp, Artificial Sequence
  Description of Artificial Sequence: Synthetic oligonucleotide
  Target: ATXN1; (-) strand; PAM type: NNNNGHTT; PAM sequence: GTATGATT
gagctacctttggaagcaat

SEQ ID NO: 28653 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
ggatgttaaaatctaaaccg

SEQ ID NO: 28654 - DNA, 20 bp, Artificial Sequence
  Description of Artificial Sequence: Synthetic oligonucleotide
  Target: ATXN1; (-) strand; PAM type: NNNNGHTT; PAM sequence: ATTGGATT
atgtttaccagagacacaca

SEQ ID NO: 28655 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
gcacggttttactgggcaag

SEQ ID NO: 28656 - DNA, 20 bp, Artificial Sequence
  Description of Artificial Sequence: Synthetic oligonucleotide
  Target: ATXN1; (-) strand; PAM type: NNNNGHTT; PAM sequence: CACGGTTT
tgtggaacatgtagtatcag

SEQ ID NO: 28657 - DNA, 20 bp, Artificial Sequence
  Description of Artificial Sequence: Synthetic oligonucleotide
  Target: ATXN1; (-) strand; PAM type: NNNNGHTT; PAM sequence: TCAGGATT
cctattttacagagattttg

SEQ ID NO: 28658 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
ggccaataaaacctatttta

SEQ ID NO: 28659 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
gaccgtgaaacccagacaaa

SEQ ID NO: 28660 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
tgcttattttttgtttgtca

SEQ ID NO: 28661 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cccggctgcaagtgcttatt

SEQ ID NO: 28662 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
gagccactgtgcccggctgc

SEQ ID NO: 28663 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tccctcggcttcccaaagtg

SEQ ID NO: 28664 - DNA, 20 bp, Artificial Sequence
  Description of Artificial Sequence: Synthetic oligonucleotide
  Target: ATXN1; (-) strand; PAM type: NNNNGHTT; PAM sequence: CTCGGCTT
acctcaggtgatccacctcc

SEQ ID NO: 28665 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttctgtatttttagtagaga

SEQ ID NO: 28666 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaagtag

SEQ ID NO: 28667 - DNA, 20 bp, Artificial Sequence
  Description of Artificial Sequence: Synthetic oligonucleotide
  Target: ATXN1; (-) strand; PAM type: NNNNGHTT; PAM sequence: CCAGGTTT
cttactgcaacctccacctc

SEQ ID NO: 28668 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
ctggagtgcagtggcacagt

SEQ ID NO: 28669 - DNA, 20 bp, Artificial Sequence
  Description of Artificial Sequence: Synthetic oligonucleotide
  Target: ATXN1; (-) strand; PAM type: NNNNGHTT; PAM sequence: CAAAGATT
aaaaaaacaaaaaaccctga

SEQ ID NO: 28670 - DNA, 20 bp, Artificial Sequence
  Description of Artificial Sequence: Synthetic oligonucleotide
  Target: ATXN1; (-) strand; PAM type: NNNNGHTT; PAM sequence: CCTCGCTT
ggtaacttttgttctcatat

SEQ ID NO: 28671 - DNA, 20 bp, Artificial Sequence
  Description of Artificial Sequence: Synthetic oligonucleotide
  Target: ATXN1; (-) strand; PAM type: NNNNGHTT; PAM sequence: GAACGCTT
gtcccgctgtgctgcctgaa

SEQ ID NO: 28672 - DNA, 20 bp, Artificial Sequence
  Description of Artificial Sequence: Synthetic oligonucleotide
  Target: ATXN1; (-) strand; PAM type: NNNNGHTT; PAM sequence: GCATGCTT
ctgtctctatgctgttgatt

SEQ ID NO: 28673 - DNA, 20 bp, Artificial Sequence
  Description of Artificial Sequence: Synthetic oligonucleotide
  Target: ATXN1; (-) strand; PAM type: NNNNGHTT; PAM sequence: TGTTGATT
atttaagactgtctctatgc

SEQ ID NO: 28674 - DNA, 20 bp, Artificial Sequence
  Description of Artificial Sequence: Synthetic oligonucleotide
  Target: ATXN1; (-) strand; PAM type: NNNNGHTT; PAM sequence: TTGCGCTT
ttgtgtttgggttattaaca

SEQ ID NO: 28675 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
ttattattcctgcacattct

SEQ ID NO: 28676 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
gacatgtacatcatgccata

SEQ ID NO: 28677 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
gccttttatttatgattctc

SEQ ID NO: 28678 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
tcaataagcatgccttttat

SEQ ID NO: 28679 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
atatctaccaaatttcatgg

SEQ ID NO: 28680 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
atttccttatttttatattt

SEQ ID NO: 28681 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
tttggtaagagtctccttga

SEQ ID NO: 28682 - DNA, 20 bp, Artificial Sequence
  Description of Artificial Sequence: Synthetic oligonucleotide
  Target: ATXN1; (-) strand; PAM type: NNNNGHTT; PAM sequence: TAGAGCTT
ttaagctttaatgttgaaaa

SEQ ID NO: 28683 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
tactctctgccccttacatt

SEQ ID NO: 28684 - DNA, 20 bp, Artificial Sequence
  Description of Artificial Sequence: Synthetic oligonucleotide
  Target: ATXN1; (-) strand; PAM type: NNNNGHTT; PAM sequence: CGTTGATT
ggatctggttctacaaccta

SEQ ID NO: 28685 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
ttaacccttccatggaatcg

SEQ ID NO: 28686 - DNA, 20 bp, Artificial Sequence
  Description of Artificial Sequence: Synthetic oligonucleotide
  Target: ATXN1; (-) strand; PAM type: NNNNGHTT; PAM sequence: ATAAGATT
agtcgttttgtacagtccaa

SEQ ID NO: 28687 - DNA, 20 bp, Artificial Sequence
  Description of Artificial Sequence: Synthetic oligonucleotide
  Target: ATXN1; (-) strand; PAM type: NNNNGHTT; PAM sequence: AGTCGTTT
cttaagtaaaacgatggggt

SEQ ID NO: 28688 - DNA, 20 bp, Artificial Sequence
  Description of Artificial Sequence: Synthetic oligonucleotide
  Target: ATXN1; (-) strand; PAM type: NNNNGHTT; PAM sequence: AGTAGATT
tcctcccacctccaccctcc

SEQ ID NO: 28689 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
tgtgtcatgggggtttgttt

SEQ ID NO: 28690 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
ggtaaacttgtgtcatgggg

SEQ ID NO: 28691 - DNA, 20 bp, Artificial Sequence
  Description of Artificial Sequence: Synthetic oligonucleotide
  Target: ATXN1; (-) strand; PAM type: NNNNGHTT; PAM sequence: GGGGGTTT
tataggtaaacttgtgtcat

SEQ ID NO: 28692 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
cctgattgacttctatgtgt

SEQ ID NO: 28693 - DNA, 20 bp, Artificial Sequence
  Description of Artificial Sequence: Synthetic oligonucleotide
  Target: ATXN1; (-) strand; PAM type: NNNNGHTT; PAM sequence: ACCTGATT
gacacccaggaaatcataaa

SEQ ID NO: 28694 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
gtctttgaagagtttatatg

SEQ ID NO: 28695 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
gtgtatggacactgtctttg

SEQ ID NO: 28696 - DNA, 20 bp, Artificial Sequence
  Description of Artificial Sequence: Synthetic oligonucleotide
  Target: ATXN1; (-) strand; PAM type: NNNNGHTT; PAM sequence: GATTGTTT
tgagatactgtggatgtgct

SEQ ID NO: 28697 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
attttgagatactgtggatg

SEQ ID NO: 28698 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
gagatgcagctttgctaagg

SEQ ID NO: 28699 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
ctctatctccaggtcagaga

SEQ ID NO: 28700 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
ctggcaccctaaagatggtt

SEQ ID NO: 28701 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
ttgctgcctggcaccctaaa

SEQ ID NO: 28702 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
ggcctcggcctcccaaagtg

SEQ ID NO: 28703 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtatatttagtagaga

SEQ ID NO: 28704 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tgcctcagcctcctgagtag

SEQ ID NO: 28705 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tttttgagacacagtttcgc

SEQ ID NO: 28706 - DNA, 20 bp, Artificial Sequence
  Description of Artificial Sequence: Synthetic oligonucleotide
  Target: ATXN1; (-) strand; PAM type: NNNNGHTT; PAM sequence: CACAGTTT
ttttttttttttttttgaga

SEQ ID NO: 28707 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
gctgttaccagatgtgacca

SEQ ID NO: 28708 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
ctttgttttttgattggggc

SEQ ID NO: 28709 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
ctgtgttctttgcctttgtt

SEQ ID NO: 28710 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
tccagagctgtgttctttgc

SEQ ID NO: 28711 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
aagatagacccctgttacat

SEQ ID NO: 28712 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
aaagcttatgtagtagatat

SEQ ID NO: 28713 - DNA, 20 bp, Artificial Sequence
  Description of Artificial Sequence: Synthetic oligonucleotide
  Target: ATXN1; (-) strand; PAM type: NNNNGHTT; PAM sequence: TAAAGCTT
gctattcactttgaaaacaa

SEQ ID NO: 28714 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
tgccaacctttggctgttct

SEQ ID NO: 28715 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
gctccctggtcctttataga

SEQ ID NO: 28716 - DNA, 20 bp, Artificial Sequence
  Description of Artificial Sequence: Synthetic oligonucleotide
  Target: ATXN1; (-) strand; PAM type: NNNNGHTT; PAM sequence: GACAGATT
tgctgcttttgcacgacaat

SEQ ID NO: 28717 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
tttgtatgagtatcttcaat

SEQ ID NO: 28718 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
ttttattggaacaccgacat

SEQ ID NO: 28719 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
ccccagcctgtttctgtaaa

SEQ ID NO: 28720 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
atgggccaaatatcacccca

SEQ ID NO: 28721 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
atgctgcagaatataccacc

SEQ ID NO: 28722 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
gaattctcagatttgcccat

SEQ ID NO: 28723 - DNA, 20 bp, Artificial Sequence
  Description of Artificial Sequence: Synthetic oligonucleotide
  Target: ATXN1; (-) strand; PAM type: NNNNGHTT; PAM sequence: CTCAGATT
ggaaaactgcacctggaatt

SEQ ID NO: 28724 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
gcccattttttaatcaaggt

SEQ ID NO: 28725 - DNA, 20 bp, Artificial Sequence
  Description of Artificial Sequence: Synthetic oligonucleotide
  Target: ATXN1; (-) strand; PAM type: NNNNGHTT; PAM sequence: GTGTGCTT
gtgatgttgagtgtcttttc

SEQ ID NO: 28726 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
ggttttgatttgcattttcc

SEQ ID NO: 28727 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
gaaatggtatgtcattgtgg

SEQ ID NO: 28728 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
tgagtgaaatggtatgtcat

SEQ ID NO: 28729 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
tgttattttcttgttttggg

SEQ ID NO: 28730 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
cttgccaacatttgttattt

SEQ ID NO: 28731 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
tatctgttcaagtgcctcct

SEQ ID NO: 28732 - DNA, 20 bp, Artificial Sequence
  Description of Artificial Sequence: Synthetic oligonucleotide
  Target: ATXN1; (-) strand; PAM type: NNNNGHTT; PAM sequence: GGTTGCTT
catccattgatggacactta

SEQ ID NO: 28733 - DNA, 20 bp, Artificial Sequence
  Description of Artificial Sequence: Synthetic oligonucleotide
  Target: ATXN1; (-) strand; PAM type: NNNNGHTT; PAM sequence: GAACGTTT
atcaccacgatccatcttca

SEQ ID NO: 28734 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
cctcccataaaccaaccctc

SEQ ID NO: 28735 - DNA, 20 bp, Artificial Sequence
  Description of Artificial Sequence: Synthetic oligonucleotide
  Target: ATXN1; (-) strand; PAM type: NNNNGHTT; PAM sequence: AGCCGATT
aagtgattcctagatgtgga

SEQ ID NO: 28736 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
ctcacattcttttttagtcc

SEQ ID NO: 28737 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
catcaggtatggtaaatttt

SEQ ID NO: 28738 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
ggttggctttgccttaatta

SEQ ID NO: 28739 - DNA, 20 bp, Artificial Sequence
  Description of Artificial Sequence: Synthetic oligonucleotide
  Target: ATXN1; (-) strand; PAM type: NNNNGHTT; PAM sequence: GTTGGCTT
actgtgatcctgaaagatag

SEQ ID NO: 28740 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
cttactcataactggagatt

SEQ ID NO: 28741 - DNA, 20 bp, Artificial Sequence
  Description of Artificial Sequence: Synthetic oligonucleotide
  Target: ATXN1; (-) strand; PAM type: NNNNGHTT; PAM sequence: TGGAGATT
agacttctcttactcataac

SEQ ID NO: 28742 - DNA, 20 bp, Artificial Sequence
  Description of Artificial Sequence: Synthetic oligonucleotide
  Target: ATXN1; (-) strand; PAM type: NNNNGHTT; PAM sequence: AGCAGCTT
ttatgccgaattagactcag

SEQ ID NO: 28743 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
aatagtgctatgcaaatagg

SEQ ID NO: 28744 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
agtaggcaatgcaaccctgt

SEQ ID NO: 28745 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
gaaaccatgactcaacgtta

SEQ ID NO: 28746 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
tgggctggcttggaggtatc

SEQ ID NO: 28747 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
gtcataggatttatggttgg

SEQ ID NO: 28748 - DNA, 20 bp, Artificial Sequence
  Description of Artificial Sequence: Synthetic oligonucleotide
  Target: ATXN1; (-) strand; PAM type: NNNNGHTT; PAM sequence: ATAGGATT
agtgtcatatatatgtggtc

SEQ ID NO: 28749 - DNA, 20 bp, Artificial Sequence
  Description of Artificial Sequence: Synthetic oligonucleotide
  Target: ATXN1; (-) strand; PAM type: NNNNGHTT; PAM sequence: GCATGATT
aataactgagttggaaaagt

SEQ ID NO: 28750 - DNA, 20 bp, Artificial Sequence
  Description of Artificial Sequence: Synthetic oligonucleotide
  Target: ATXN1; (-) strand; PAM type: NNNNGHTT; PAM sequence: CCCTGATT
gttacagtagagatgtgtgc

SEQ ID NO: 28751 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
ttcaggtacacatttttatt

SEQ ID NO: 28752 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
taaacatttctgcacacacc

SEQ ID NO: 28753 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
cttgaaattggccatggtgg

SEQ ID NO: 28754 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
tggaccagtggtgtagtgga

SEQ ID NO: 28755 - DNA, 20 bp, Artificial Sequence
  Description of Artificial Sequence: Synthetic oligonucleotide
  Target: ATXN1; (-) strand; PAM type: NNNNGHTT; PAM sequence: TAGGGTTT
ggtttattttaggtaggaag

SEQ ID NO: 28756 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
ataatgaaggactttgcttc

SEQ ID NO: 28757 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
aagccgaaaataatgaagga

SEQ ID NO: 28758 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
ttatacaagagcagacttag

SEQ ID NO: 28759 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
gcctaagagcattcaaagaa

SEQ ID NO: 28760 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
aatccaagtcagacttggtg

SEQ ID NO: 28761 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
gcagcccagccagtcaactc

SEQ ID NO: 28762 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
gccctgtgaaatcttcatgc

SEQ ID NO: 28763 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
gctccccctcttccttttgt

SEQ ID NO: 28764 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
aggaactaagttctgggtgc

SEQ ID NO: 28765 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
catttctccaaagacccctg

SEQ ID NO: 28766 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
cagccatttctccaaagacc

SEQ ID NO: 28767 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
atgcccccatcactgtgggg

SEQ ID NO: 28768 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
gttgtttattttgttgctct

SEQ ID NO: 28769 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
taggttctaatccagtacta

SEQ ID NO: 28770 - DNA, 20 bp, Artificial Sequence
  Description of Artificial Sequence: Synthetic oligonucleotide
  Target: ATXN1; (-) strand; PAM type: NNNNGHTT; PAM sequence: GGGTGTTT
ttatatcaatatgaactcat

SEQ ID NO: 28771 - DNA, 20 bp, Artificial Sequence
  Description of Artificial Sequence: Synthetic oligonucleotide
  Target: ATXN1; (-) strand; PAM type: NNNNGHTT; PAM sequence: GCGTGTTT
aactcctttgctcaagagat

SEQ ID NO: 28772 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
gacctcagccgaggttgtgt

SEQ ID NO: 28773 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
agtctgtactccttaaaatt

SEQ ID NO: 28774 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
aaattgagggacagtccaca

SEQ ID NO: 28775 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
ctctttggccccacaaagtg

SEQ ID NO: 28776 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
tggtttttttttggtagagt

SEQ ID NO: 28777 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
agctaatttggtttttggtt

SEQ ID NO: 28778 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
cacatccagctaatttggtt

SEQ ID NO: 28779 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
aggctaccacatccagctaa

SEQ ID NO: 28780 - DNA, 20 bp, Artificial Sequence
  Description of Artificial Sequence: Synthetic oligonucleotide
  Target: ATXN1; (-) strand; PAM type: NNNNGHTT; PAM sequence: CGGGGCTT
ctcactgcagactggacctt

SEQ ID NO: 28781 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
aataaaatattggctttagt

SEQ ID NO: 28782 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
ttactcaatcaaaataaaat

SEQ ID NO: 28783 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
tctgtccatcctgcagtcca

SEQ ID NO: 28784 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
tgcaaataatattttgctat

SEQ ID NO: 28785 - DNA, 20 bp, Artificial Sequence
  Description of Artificial Sequence: Synthetic oligonucleotide
  Target: ATXN1; (-) strand; PAM type: NNNNGHTT; PAM sequence: CCTAGATT
gaacacccataaacttgcca

SEQ ID NO: 28786 - DNA, 20 bp, Artificial Sequence
  Description of Artificial Sequence: Synthetic oligonucleotide
  Target: ATXN1; (-) strand; PAM type: NNNNGHTT; PAM sequence: GGCAGTTT
tgcctttcactgctaagggg

SEQ ID NO: 28787 - DNA, 20 bp, Artificial Sequence
  Description of Artificial Sequence: Synthetic oligonucleotide
  Target: ATXN1; (-) strand; PAM type: NNNNGHTT; PAM sequence: TATGGCTT
agtctagagctcatatccta

SEQ ID NO: 28788 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
gaaatccatccaagccacaa

SEQ ID NO: 28789 - DNA, 20 bp, Artificial Sequence
  Description of Artificial Sequence: Synthetic oligonucleotide
  Target: ATXN1; (-) strand; PAM type: NNNNGHTT; PAM sequence: CCAAGTTT
aaggtagaatgagtaaataa

SEQ ID NO: 28790 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
acctcttatcaaaaaaaaaa

SEQ ID NO: 28791 - DNA, 20 bp, Artificial Sequence
  Description of Artificial Sequence: Synthetic oligonucleotide
  Target: ATXN1; (-) strand; PAM type: NNNNGHTT; PAM sequence: GTACGTTT
tcatgtttgaatcacaagag

SEQ ID NO: 28792 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
tataaaagataataataatc

SEQ ID NO: 28793 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
gcacacttaaaatgctctga

SEQ ID NO: 28794 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
atagcaaggaaatactctag

SEQ ID NO: 28795 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
cctgtggcggttggcgaggc

SEQ ID NO: 28796 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgccccagcctcccaaagtg

SEQ ID NO: 28797 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
ttgcgtctttttagtagtga

SEQ ID NO: 28798 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
tgccccagcctgccgactag

SEQ ID NO: 28799 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctctacctcctgggttc

SEQ ID NO: 28800 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
tttttttcttttttttgaga

SEQ ID NO: 28801 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
tttttagcttccaaatcgaa

SEQ ID NO: 28802 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
cacctggccaagacaccttt

SEQ ID NO: 28803 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tgctttgacctcccaagtag

SEQ ID NO: 28804 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
gacctgggtttaagtgattc

SEQ ID NO: 28805 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
cagcaagctgacctgggttt

SEQ ID NO: 28806 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
gaagttgccagcaagctgac

SEQ ID NO: 28807 - DNA, 20 bp, Artificial Sequence
  Description of Artificial Sequence: Synthetic oligonucleotide
  Target: ATXN1; (-) strand; PAM type: NNNNGHTT; PAM sequence: AGGGGTTT
gaaggaatttaattattaca

SEQ ID NO: 28808 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
tatctgaaaacagtgaggtt

SEQ ID NO: 28809 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
aacacctataatactgctct

SEQ ID NO: 28810 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
aagtataattaaaaacaaaa

SEQ ID NO: 28811 - DNA, 20 bp, Artificial Sequence
  Description of Artificial Sequence: Synthetic oligonucleotide
  Target: ATXN1; (-) strand; PAM type: NNNNGHTT; PAM sequence: GATTGCTT
ttgggaggctgaggcgagag

SEQ ID NO: 28812 - DNA, 20 bp, Artificial Sequence
  Description of Artificial Sequence: Synthetic oligonucleotide
  Target: ATXN1; (-) strand; PAM type: NNNNGHTT; PAM sequence: AGAGGATT
ctacttgggaggctgaggcg

SEQ ID NO: 28813 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
aacacattagccctgtgatt

SEQ ID NO: 28814 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
gctggatcaacacattagcc

SEQ ID NO: 28815 - DNA, 20 bp, Artificial Sequence
  Description of Artificial Sequence: Synthetic oligonucleotide
  Target: ATXN1; (-) strand; PAM type: NNNNGHTT; PAM sequence: AGATGCTT
ggacagagctgaagatgaaa

SEQ ID NO: 28816 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
taggcctctgagctagttgg

SEQ ID NO: 28817 - DNA, 20 bp, Artificial Sequence
  Description of Artificial Sequence: Synthetic oligonucleotide
  Target: ATXN1; (-) strand; PAM type: NNNNGHTT; PAM sequence: ATTAGATT
ctcctctcttatctcttttc

SEQ ID NO: 28818 - DNA, 20 bp, Artificial Sequence
  Description of Artificial Sequence: Synthetic oligonucleotide
  Target: ATXN1; (-) strand; PAM type: NNNNGHTT; PAM sequence: GGCTGATT
atatctgggtgagatattgg

SEQ ID NO: 28819 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
aaatcggtgtgagagtgact

SEQ ID NO: 28820 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
gatccctggttatagaatgt

SEQ ID NO: 28821 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
catgcagggtgcccccttga

SEQ ID NO: 28822 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
catctgcctctaagggtgta

SEQ ID NO: 28823 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
ctctcagacttaaacaaagg

SEQ ID NO: 28824 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
cactcctctcagacttaaac

SEQ ID NO: 28825 - DNA, 20 bp, Artificial Sequence
  Description of Artificial Sequence: Synthetic oligonucleotide
  Target: ATXN1; (-) strand; PAM type: NNNNGHTT; PAM sequence: GTTGGATT
ccttttctcctttttttgag

SEQ ID NO: 28826 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
gaaaagagttccgaacagta

SEQ ID NO: 28827 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
cagtcccctgtcattgcact

SEQ ID NO: 28828 - DNA, 20 bp, Artificial Sequence
  Description of Artificial Sequence: Synthetic oligonucleotide
  Target: ATXN1; (-) strand; PAM type: NNNNGHTT; PAM sequence: TCTTGATT
atgcactgtgaaattctgtt

SEQ ID NO: 28829 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
ttcaccaatgcactgtgaaa

SEQ ID NO: 28830 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
cactctataatgtttattat

SEQ ID NO: 28831 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
gacacagagtaagcactcta

SEQ ID NO: 28832 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
cactccagcctggtgacaga

SEQ ID NO: 28833 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
gtgactctagagcctaactc

SEQ ID NO: 28834 - DNA, 20 bp, Artificial Sequence
  Description of Artificial Sequence: Synthetic oligonucleotide
  Target: ATXN1; (-) strand; PAM type: NNNNGHTT; PAM sequence: GGCAGTTT
aatattgctgttcttaacca

SEQ ID NO: 28835 - DNA, 20 bp, Artificial Sequence
  Description of Artificial Sequence: Synthetic oligonucleotide
  Target: ATXN1; (-) strand; PAM type: NNNNGHTT; PAM sequence: TAAGGATT
gcctgtctcccacagcaatt

SEQ ID NO: 28836 - DNA, 20 bp, Artificial Sequence
  Description of Artificial Sequence: Synthetic oligonucleotide
  Target: ATXN1; (-) strand; PAM type: NNNNGHTT; PAM sequence: ACAAGTTT
ctcattttccttatttcaaa

SEQ ID NO: 28837 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
aatatgaccttagacaagtc

SEQ ID NO: 28838 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
aaaaaaattttttttaaacc

SEQ ID NO: 28839 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
gatattctgaggctatgtaa

SEQ ID NO: 28840 - DNA, 20 bp, Artificial Sequence
  Description of Artificial Sequence: Synthetic oligonucleotide
  Target: ATXN1; (-) strand; PAM type: NNNNGHTT; PAM sequence: GGCAGCTT
tctattgaccggggcagcgg

SEQ ID NO: 28841 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
tgtggttggtcaccctctct

SEQ ID NO: 28842 - DNA, 20 bp, Artificial Sequence
  Description of Artificial Sequence: Synthetic oligonucleotide
  Target: ATXN1; (-) strand; PAM type: NNNNGHTT; PAM sequence: CCCTGTTT
aaccaggtcaccagaggttg

SEQ ID NO: 28843 - DNA, 20 bp, Artificial Sequence
  Description of Artificial Sequence: Synthetic oligonucleotide
  Target: ATXN1; (-) strand; PAM type: NNNNGHTT; PAM sequence: CCCAGATT
agtctgccgcctggaagaat

SEQ ID NO: 28844 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
aaaattgctctctctccctg

SEQ ID NO: 28845 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
cactcagggctttctgcctc

SEQ ID NO: 28846 - DNA, 20 bp, Artificial Sequence
  Description of Artificial Sequence: Synthetic oligonucleotide
  Target: ATXN1; (-) strand; PAM type: NNNNGHTT; PAM sequence: CAGGGCTT
ctcagacgttctgtaacact

SEQ ID NO: 28847 - DNA, 20 bp, Artificial Sequence
  Description of Artificial Sequence: Synthetic oligonucleotide
  Target: ATXN1; (-) strand; PAM type: NNNNGHTT; PAM sequence: CGTAGCTT
gagttttagttgtgccactg

SEQ ID NO: 28848 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
ggggcaagatgtcagaaatc

SEQ ID NO: 28849 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
cacattgtactttctgtcct

SEQ ID NO: 28850 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
tcccccagaaggccttaaga

SEQ ID NO: 28851 - DNA, 20 bp, Artificial Sequence
  Description of Artificial Sequence: Synthetic oligonucleotide
  Target: ATXN1; (-) strand; PAM type: NNNNGHTT; PAM sequence: TGGCGTTT
cttcaagtaattcttggtgg

SEQ ID NO: 28852 - DNA, 20 bp, Artificial Sequence
  Description of Artificial Sequence: Synthetic oligonucleotide
  Target: ATXN1; (-) strand; PAM type: NNNNGHTT; PAM sequence: GGGCGCTT
agagaacccattggaagcct

SEQ ID NO: 28853 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
gaaatctcatctggagtgaa

SEQ ID NO: 28854 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
ctgctatttgaagagcgcaa

SEQ ID NO: 28855 - DNA, 20 bp, Artificial Sequence
  Description of Artificial Sequence: Synthetic oligonucleotide
  Target: ATXN1; (-) strand; PAM type: NNNNGHTT; PAM sequence: GATCGTTT
agcagcacgtctcttaatgt

SEQ ID NO: 28856 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
tgtgaaaaactaagatagcc

SEQ ID NO: 28857 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
atatacataaaggtactatt

SEQ ID NO: 28858 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
tatgattgttctattttatt

SEQ ID NO: 28859 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
acttttagtacagtataatg

SEQ ID NO: 28860 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
ccatcttcggtgtcattttc

SEQ ID NO: 28861 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
aaaggccatttgtggacatg

SEQ ID NO: 28862 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
ccagagctcagctccctggg

SEQ ID NO: 28863 - DNA, 20 bp, Artificial Sequence
  Description of Artificial Sequence: Synthetic oligonucleotide
  Target: ATXN1; (-) strand; PAM type: NNNNGHTT; PAM sequence: CTGGGCTT
ccaggccagagctcagctcc

SEQ ID NO: 28864 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
acttttgcctgtaaacttct

SEQ ID NO: 28865 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
ataaaattggtcacgtatcc

SEQ ID NO: 28866 - DNA, 20 bp, Artificial Sequence
  Description of Artificial Sequence: Synthetic oligonucleotide
  Target: ATXN1; (-) strand; PAM type: NNNNGHTT; PAM sequence: GCATGCTT
taaattcctctgagccctag

SEQ ID NO: 28867 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
gctctaaaagcatcaagtag

SEQ ID NO: 28868 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
tagtgaccctatgggaagtc

SEQ ID NO: 28869 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
gataacattattatattttg

SEQ ID NO: 28870 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
acttcagacttgatagtaaa

SEQ ID NO: 28871 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
attcaccaactcccttgttt

SEQ ID NO: 28872 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
cttgagaaattcaccaactc

SEQ ID NO: 28873 - DNA, 20 bp, Artificial Sequence
  Description of Artificial Sequence: Synthetic oligonucleotide
  Target: ATXN1; (-) strand; PAM type: NNNNGHTT; PAM sequence: GAAGGATT
agcccccaaaagttatttag

SEQ ID NO: 28874 - DNA, 20 bp, Artificial Sequence
  Description of Artificial Sequence: Synthetic oligonucleotide
  Target: ATXN1; (-) strand; PAM type: NNNNGHTT; PAM sequence: CCAGGATT
tcacatgattgtagctacac

SEQ ID NO: 28875 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
ctgtcattagggggagtttc

SEQ ID NO: 28876 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
atcctctagctgtcattagg

SEQ ID NO: 28877 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
ctattaaggaaggagaagga

SEQ ID NO: 28878 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
cctggacctgaagaccttgg

SEQ ID NO: 28879 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
atttgccatgctcttagaaa

SEQ ID NO: 28880 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
tctattagtggcctcatcag

SEQ ID NO: 28881 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
aattatgaaactcttttcca

SEQ ID NO: 28882 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
ggcatttgaacttgtggttc

SEQ ID NO: 28883 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
tttgttgatgatgaagtggt

SEQ ID NO: 28884 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
aataggtttgttgatgatga

SEQ ID NO: 28885 - DNA, 20 bp, Artificial Sequence
  Description of Artificial Sequence: Synthetic oligonucleotide
  Target: ATXN1; (-) strand; PAM type: NNNNGHTT; PAM sequence: ATAGGTTT
ttaaaagttctagtaggcaa

SEQ ID NO: 28886 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
tttacttgaatagtttgcag

SEQ ID NO: 28887 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
cccacaaggttgtttacttg

SEQ ID NO: 28888 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
ccatgtcaaccaccccacaa

SEQ ID NO: 28889 - DNA, 20 bp, Artificial Sequence
  Description of Artificial Sequence: Synthetic oligonucleotide
  Target: ATXN1; (-) strand; PAM type: NNNNGHTT; PAM sequence: TCATGATT
tgctaccaagtgccacctgc

SEQ ID NO: 28890 - DNA, 20 bp, Artificial Sequence
  Description of Artificial Sequence: Synthetic oligonucleotide
  Target: ATXN1; (-) strand; PAM type: NNNNGHTT; PAM sequence: TCAGGCTT
ttcactaaatgtgaatattt

SEQ ID NO: 28891 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
tgaattgtagaaaagagtac

SEQ ID NO: 28892 - DNA, 20 bp, Artificial Sequence
  Description of Artificial Sequence: Synthetic oligonucleotide
  Target: ATXN1; (-) strand; PAM type: NNNNGHTT; PAM sequence: ACCAGTTT
aaagctgctctctatttctc

SEQ ID NO: 28893 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
cttaacagctaatacgatag

SEQ ID NO: 28894 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
actctgaaggaaagaaagcc

SEQ ID NO: 28895 - DNA, 20 bp, Artificial Sequence
  Description of Artificial Sequence: Synthetic oligonucleotide
  Target: ATXN1; (-) strand; PAM type: NNNNGHTT; PAM sequence: CCTTGATT
ttctgcttctaaaatgcaca

SEQ ID NO: 28896 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
gaattttccatgaaaaaacc

SEQ ID NO: 28897 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
ttctattgtgagtctttggt

SEQ ID NO: 28898 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
tgcttgaagacacaatcagc

SEQ ID NO: 28899 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
gatgaaattacagttctggg

SEQ ID NO: 28900 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
ttagggatgaaattacagtt

SEQ ID NO: 28901 - DNA, 20 bp, Artificial Sequence
  Description of Artificial Sequence: Synthetic oligonucleotide
  Target: ATXN1; (-) strand; PAM type: NNNNGHTT; PAM sequence: GGGAGCTT
tgaggacctcaggaaaatga

SEQ ID NO: 28902 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
agagagatgggagttggggg

SEQ ID NO: 28903 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
tgagattaaaattcaggatt

SEQ ID NO: 28904 - DNA, 20 bp, Artificial Sequence
  Description of Artificial Sequence: Synthetic oligonucleotide
  Target: ATXN1; (-) strand; PAM type: NNNNGHTT; PAM sequence: TCAGGATT
ggcaaagctgagattaaaat

SEQ ID NO: 28905 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
ggctcagaaaaatggcaaag

SEQ ID NO: 28906 - DNA, 20 bp, Artificial Sequence
  Description of Artificial Sequence: Synthetic oligonucleotide
  Target: ATXN1; (-) strand; PAM type: NNNNGHTT; PAM sequence: AACAGCTT
gtctaagctttatggcttct

SEQ ID NO: 28907 - DNA, 20 bp, Artificial Sequence
  Description of Artificial Sequence: Synthetic oligonucleotide
  Target: ATXN1; (-) strand; PAM type: NNNNGHTT; PAM sequence: TATGGCTT
tcatctcatagtctaagctt

SEQ ID NO: 28908 - DNA, 20 bp, Artificial Sequence
  Description of Artificial Sequence: Synthetic oligonucleotide
  Target: ATXN1; (-) strand; PAM type: NNNNGHTT; PAM sequence: CTAAGCTT
cacggaagtcatctcatagt

SEQ ID NO: 28909 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tgatttatattatatgaaac

SEQ ID NO: 28910 - DNA, 20 bp, Artificial Sequence
  Description of Artificial Sequence: Synthetic oligonucleotide
  Target: ATXN1; (-) strand; PAM type: NNNNGHTT; PAM sequence: TGTTGATT
cctttttcctccttgggaaa

SEQ ID NO: 28911 - DNA, 20 bp, Artificial Sequence
  Description of Artificial Sequence: Synthetic oligonucleotide
  Target: ATXN1; (-) strand; PAM type: NNNNGHTT; PAM sequence: TTGGGCTT
tttcccttttcccactttcc

SEQ ID NO: 28912 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
aagtccacaacaaagagagg

SEQ ID NO: 28913 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
tgttgtaagtccacttcggt

SEQ ID NO: 28914 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
tttatttgcttcttattttt

SEQ ID NO: 28915 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
tctgttaggcaaaacctttt

SEQ ID NO: 28916 - DNA, 20 bp, Artificial Sequence
  Description of Artificial Sequence: Synthetic oligonucleotide
  Target: ATXN1; (-) strand; PAM type: NNNNGHTT; PAM sequence: ATGGGATT
gggtttggggttggtttaga

SEQ ID NO: 28917 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
gccaaatctcagggtttggg

SEQ ID NO: 28918 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
gtgcattgaaagccaaatct

SEQ ID NO: 28919 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
ttaaaaatgacaagatttcc

SEQ ID NO: 28920 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
ggcggtggatgttaaaaatg

SEQ ID NO: 28921 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
cttctctctgacgcctggtg

SEQ ID NO: 28922 - DNA, 20 bp, Artificial Sequence
  Description of Artificial Sequence: Synthetic oligonucleotide
  Target: ATXN1; (-) strand; PAM type: NNNNGHTT; PAM sequence: CACCGCTT
ggtagaccatccacacacac

SEQ ID NO: 28923 - DNA, 20 bp, Artificial Sequence
  Description of Artificial Sequence: Synthetic oligonucleotide
  Target: ATXN1; (-) strand; PAM type: NNNNGHTT; PAM sequence: CTCGGATT
agccctgcagacaccttgat

SEQ ID NO: 28924 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
aagctgggagaggggcatgg

SEQ ID NO: 28925 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
gaacaatggctttatttgga

SEQ ID NO: 28926 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
acctcccagtgtccatgaac

SEQ ID NO: 28927 - DNA, 20 bp, Artificial Sequence
  Description of Artificial Sequence: Synthetic oligonucleotide
  Target: ATXN1; (-) strand; PAM type: NNNNGHTT; PAM sequence: CTAGGTTT
tgtgtagtaggctgtcccat

SEQ ID NO: 28928 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
tcagtacagtatcatgcagt

SEQ ID NO: 28929 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
tgtatcttttctatatttag

SEQ ID NO: 28930 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
ggtgtaccatattttatctt

SEQ ID NO: 28931 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
tggtgcagcctaagtgtata

SEQ ID NO: 28932 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
agtaaaaaagttacagtaag

SEQ ID NO: 28933 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
gagtcgaaaagttttaaata

SEQ ID NO: 28934 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
aagtattattacaagagtcg

SEQ ID NO: 28935 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
tcgtacaactttaaagtgga

SEQ ID NO: 28936 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
ttttaaaaatgaaaatagaa

SEQ ID NO: 28937 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
cttagtattgttttaaaaaa

SEQ ID NO: 28938 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
caccactgctcctgccttag

SEQ ID NO: 28939 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgcctcggcctcccaaagtg

SEQ ID NO: 28940 - DNA, 20 bp, Artificial Sequence
  Description of Artificial Sequence: Synthetic oligonucleotide
  Target: ATXN1; (-) strand; PAM type: NNNNGHTT; PAM sequence: CGGAGTTT
ttttgtatttttagcagaga

SEQ ID NO: 28941 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcctgagtag

SEQ ID NO: 28942 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gtttgtttcttagtatttta

SEQ ID NO: 28943 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
ataggcctagactaatgcgt

SEQ ID NO: 28944 - DNA, 20 bp, Artificial Sequence
  Description of Artificial Sequence: Synthetic oligonucleotide
  Target: ATXN1; (-) strand; PAM type: NNNNGHTT; PAM sequence: GCGTGTTT
ctgtataggcctagactaat

SEQ ID NO: 28945 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
tactatactatacttttgat

SEQ ID NO: 28946 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
aatggtaataaacaactgtt

SEQ ID NO: 28947 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
atgcaattcggtacagcaca

SEQ ID NO: 28948 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
cctagtgcaactcattactc

SEQ ID NO: 28949 - DNA, 20 bp, Artificial Sequence
  Description of Artificial Sequence: Synthetic oligonucleotide
  Target: ATXN1; (-) strand; PAM type: NNNNGHTT; PAM sequence: ATAAGATT
acatatatcatgatagtccc

SEQ ID NO: 28950 - DNA, 20 bp, Artificial Sequence
  Description of Artificial Sequence: Synthetic oligonucleotide
  Target: ATXN1; (-) strand; PAM type: NNNNGHTT; PAM sequence: TATGGCTT
ctggttccgcttccctcact

SEQ ID NO: 28951 - DNA, 20 bp, Artificial Sequence
  Description of Artificial Sequence: Synthetic oligonucleotide
  Target: ATXN1; (-) strand; PAM type: NNNNGHTT; PAM sequence: TTCCGCTT
gacacctatatgggagctgg

SEQ ID NO: 28952 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
catctctgcctcccaaagtg

SEQ ID NO: 28953 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttgcatttttagtagaga

SEQ ID NO: 28954 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctgagcctcctgagtag

SEQ ID NO: 28955 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
ttttttttttttttttgaga

SEQ ID NO: 28956 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
cataggtatacatgtgttct

SEQ ID NO: 28957 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
tggaagaggccatgttgaca

SEQ ID NO: 28958 - DNA, 20 bp, Artificial Sequence
  Description of Artificial Sequence: Synthetic oligonucleotide
  Target: ATXN1; (-) strand; PAM type: NNNNGHTT; PAM sequence: CTCAGATT
tcccttttctaggataccct

SEQ ID NO: 28959 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
tagaaatagatcaaaatgta

SEQ ID NO: 28960 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
cttacctaacctttttgagc

SEQ ID NO: 28961 - DNA, 20 bp, Artificial Sequence
  Description of Artificial Sequence: Synthetic oligonucleotide
  Target: ATXN1; (-) strand; PAM type: NNNNGHTT; PAM sequence: TTGAGCTT
ggctgacttacctaaccttt

SEQ ID NO: 28962 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
agagatgagtattttggctc

SEQ ID NO: 28963 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
aggtgatattattgctacca

SEQ ID NO: 28964 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
tgaagttaaaacattttgga

SEQ ID NO: 28965 - DNA, 20 bp, Artificial Sequence
  Description of Artificial Sequence: Synthetic oligonucleotide
  Target: ATXN1; (-) strand; PAM type: NNNNGHTT; PAM sequence: TCATGATT
aaaatggggctaggagtaac

SEQ ID NO: 28966 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
ttcaggtccactgtcaactc

SEQ ID NO: 28967 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
ctagtttttgaattaggatg

SEQ ID NO: 28968 - DNA, 20 bp, Artificial Sequence
  Description of Artificial Sequence: Synthetic oligonucleotide
  Target: ATXN1; (-) strand; PAM type: NNNNGHTT; PAM sequence: ACTAGTTT
tatcccctctgaaaagccat

SEQ ID NO: 28969 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
taaaatatgtaggaacttat

SEQ ID NO: 28970 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
aaacccatcacagaaataca

SEQ ID NO: 28971 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
gtcttgtatgacttgcctag

SEQ ID NO: 28972 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
catgaattagaaaatatatt

SEQ ID NO: 28973 - DNA, 20 bp, Artificial Sequence
  Description of Artificial Sequence: Synthetic oligonucleotide
  Target: ATXN1; (-) strand; PAM type: NNNNGHTT; PAM sequence: CTCAGATT
ttttatttctttagcattag

SEQ ID NO: 28974 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
tttcttcccactttttctca

SEQ ID NO: 28975 - DNA, 20 bp, Artificial Sequence
  Description of Artificial Sequence: Synthetic oligonucleotide
  Target: ATXN1; (-) strand; PAM type: NNNNGHTT; PAM sequence: ACACGTTT
ggtctcttgaacatattagc

SEQ ID NO: 28976 - DNA, 20 bp, Artificial Sequence
  Description of Artificial Sequence: Synthetic oligonucleotide
  Target: ATXN1; (-) strand; PAM type: NNNNGHTT; PAM sequence: CTCAGATT
tcggaaatcttcagaagtcc

SEQ ID NO: 28977 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
agagaggtcagggctcgact

SEQ ID NO: 28978 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
acttttcttttccttatttt

SEQ ID NO: 28979 - DNA, 20 bp, Artificial Sequence
  Description of Artificial Sequence: Synthetic oligonucleotide
  Target: ATXN1; (-) strand; PAM type: NNNNGHTT; PAM sequence: TTTCGATT
tgactaacatagacttgatt

SEQ ID NO: 28980 - DNA, 20 bp, Artificial Sequence
  Description of Artificial Sequence: Synthetic oligonucleotide
  Target: ATXN1; (-) strand; PAM type: NNNNGHTT; PAM sequence: ACTTGATT
gagagaaatgactaacatag

SEQ ID NO: 28981 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
atacgcacacaggtgcatct

SEQ ID NO: 28982 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
ggatccttattctggacttt

SEQ ID NO: 28983 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
agttggggtacagtggcata

SEQ ID NO: 28984 - DNA, 20 bp, Artificial Sequence
  Description of Artificial Sequence: Synthetic oligonucleotide
  Target: ATXN1; (-) strand; PAM type: NNNNGHTT; PAM sequence: TAAGGATT
ctccccactacatggcttca

SEQ ID NO: 28985 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
atgggggacactccccacta

SEQ ID NO: 28986 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
acacactgtgtgaatgaagg

SEQ ID NO: 28987 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
cctttggttctctggcgttt

SEQ ID NO: 28988 - DNA, 20 bp, Artificial Sequence
  Description of Artificial Sequence: Synthetic oligonucleotide
  Target: ATXN1; (-) strand; PAM type: NNNNGHTT; PAM sequence: TGGCGTTT
gtcgaagccctttggttctc

SEQ ID NO: 28989 - DNA, 20 bp, Artificial Sequence
  Description of Artificial Sequence: Synthetic oligonucleotide
  Target: ATXN1; (-) strand; PAM type: NNNNGHTT; PAM sequence: GTGCGATT
attggaaagtcatggtatct

SEQ ID NO: 28990 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
gaatttgaacaacacctccg

SEQ ID NO: 28991 - DNA, 20 bp, Artificial Sequence
  Description of Artificial Sequence: Synthetic oligonucleotide
  Target: ATXN1; (-) strand; PAM type: NNNNGHTT; PAM sequence: CACAGTTT
tgatcttataagacccaaac

SEQ ID NO: 28992 - DNA, 20 bp, Artificial Sequence
  Description of Artificial Sequence: Synthetic oligonucleotide
  Target: ATXN1; (-) strand; PAM type: NNNNGHTT; PAM sequence: GTATGCTT
agtcatacagtatttggaat

SEQ ID NO: 28993 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
aggagcaagatctaccttag

SEQ ID NO: 28994 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
gcaggacttccatgagggtc

SEQ ID NO: 28995 - DNA, 20 bp, Artificial Sequence
  Description of Artificial Sequence: Synthetic oligonucleotide
  Target: ATXN1; (-) strand; PAM type: NNNNGHTT; PAM sequence: CACGGATT
aaatagccattattcagaac

SEQ ID NO: 28996 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
aagctataatagcttttggt

SEQ ID NO: 28997 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
aggagaaagctataatagct

SEQ ID NO: 28998 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
ctctggaaggagaaagctat

SEQ ID NO: 28999 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
ctttcaaagctttccctatt

SEQ ID NO: 29000 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
gctttgcctatactgccttt

SEQ ID NO: 29001 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
tgttcccacccctaaatgct

SEQ ID NO: 29002 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
ggataactgttcccacccct

SEQ ID NO: 29003 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
agtgctgccctgtccttcaa

SEQ ID NO: 29004 - DNA, 20 bp, Artificial Sequence
  Description of Artificial Sequence: Synthetic oligonucleotide
  Target: ATXN1; (-) strand; PAM type: NNNNGHTT; PAM sequence: AAACGATT
tccctcgattacatcatctt

SEQ ID NO: 29005 - DNA, 20 bp, Artificial Sequence
  Description of Artificial Sequence: Synthetic oligonucleotide
  Target: ATXN1; (-) strand; PAM type: NNNNGHTT; PAM sequence: CCTCGATT
gcccccaaattatttttgtc

SEQ ID NO: 29006 - DNA, 20 bp, Artificial Sequence
  Description of Artificial Sequence: Synthetic oligonucleotide
  Target: ATXN1; (-) strand; PAM type: NNNNGHTT; PAM sequence: AGTAGATT
gaatcacttgttataccatt

SEQ ID NO: 29007 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
tgatggccttgaacaaaagt

SEQ ID NO: 29008 - DNA, 20 bp, Artificial Sequence
  Description of Artificial Sequence: Synthetic oligonucleotide
  Target: ATXN1; (-) strand; PAM type: NNNNGHTT; PAM sequence: AGTAGATT
tagcacagggctaaacgcat

SEQ ID NO: 29009 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
aaatgagctctggcccaggg

SEQ ID NO: 29010 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
taatgtctctcgggtgggtt

SEQ ID NO: 29011 - DNA, 20 bp, Artificial Sequence
  Description of Artificial Sequence: Synthetic oligonucleotide
  Target: ATXN1; (-) strand; PAM type: NNNNGHTT; PAM sequence: GTGGGTTT
gtgacagtaatgtctctcgg

SEQ ID NO: 29012 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
tcaggaggctgaggcaggag

SEQ ID NO: 29013 - DNA, 20 bp, Artificial Sequence
  Description of Artificial Sequence: Synthetic oligonucleotide
  Target: ATXN1; (-) strand; PAM type: NNNNGHTT; PAM sequence: TCATGCTT
acatggccaggcatagtggc

SEQ ID NO: 29014 - DNA, 20 bp, Artificial Sequence
  Description of Artificial Sequence: Synthetic oligonucleotide
  Target: ATXN1; (-) strand; PAM type: NNNNGHTT; PAM sequence: GTGGGATT
gacaggacagatgagccagc

SEQ ID NO: 29015 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
cagtcccagggtatgagatg

SEQ ID NO: 29016 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
acaggaagcatgttcttggg

SEQ ID NO: 29017 - DNA, 20 bp, Artificial Sequence
  Description of Artificial Sequence: Synthetic oligonucleotide
  Target: ATXN1; (-) strand; PAM type: NNNNGHTT; PAM sequence: GATGGATT
acctccgagatgatggttga

SEQ ID NO: 29018 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
catcaggaccaaggatgaag

SEQ ID NO: 29019 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
gtagagagcagttgctcagg

SEQ ID NO: 29020 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
tgtacatctagcacctcaca

SEQ ID NO: 29021 - DNA, 20 bp, Artificial Sequence
  Description of Artificial Sequence: Synthetic oligonucleotide
  Target: ATXN1; (-) strand; PAM type: NNNNGHTT; PAM sequence: CACGGCTT
tgcaagtaatgcctacagtt

SEQ ID NO: 29022 - DNA, 20 bp, Artificial Sequence
  Description of Artificial Sequence: Synthetic oligonucleotide
  Target: ATXN1; (-) strand; PAM type: NNNNGHTT; PAM sequence: CCTAGTTT
agctactgaacttttctgag

SEQ ID NO: 29023 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
tatggtagcattgttaggtg

SEQ ID NO: 29024 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
taggcgagtctgccttagtg

SEQ ID NO: 29025 - DNA, 20 bp, Artificial Sequence
  Description of Artificial Sequence: Synthetic oligonucleotide
  Target: ATXN1; (-) strand; PAM type: NNNNGHTT; PAM sequence: TTCCGATT
aaactttcttttatgtgatt

SEQ ID NO: 29026 - DNA, 20 bp, Artificial Sequence
  Description of Artificial Sequence: Synthetic oligonucleotide
  Target: ATXN1; (-) strand; PAM type: NNNNGHTT; PAM sequence: ATGTGATT
tcatgtcaaaactttctttt

SEQ ID NO: 29027 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
cagaacaatgtggccaccca

SEQ ID NO: 29028 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
ttagggaaactgatgcgtcc

SEQ ID NO: 29029 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
gtgttgtggtcataaacaaa

SEQ ID NO: 29030 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
gacagtaacaattgaggctt

SEQ ID NO: 29031 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
aaacaaaagacagtaacaat

SEQ ID NO: 29032 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
tggtgccattaaagaaaaaa

SEQ ID NO: 29033 - DNA, 20 bp, Artificial Sequence
  Description of Artificial Sequence: Synthetic oligonucleotide
  Target: ATXN1; (-) strand; PAM type: NNNNGHTT; PAM sequence: TGTTGATT
cctattgaaacatgtttata

SEQ ID NO: 29034 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
gaaaaagaatgcctattgaa

SEQ ID NO: 29035 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
aaatgataaagagtctccga

SEQ ID NO: 29036 - DNA, 20 bp, Artificial Sequence
  Description of Artificial Sequence: Synthetic oligonucleotide
  Target: ATXN1; (-) strand; PAM type: NNNNGHTT; PAM sequence: GGTAGTTT
gataaaccaaatattactag

SEQ ID NO: 29037 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
aagctataggaatatgtagt

SEQ ID NO: 29038 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tttttcttaccagcattgac

SEQ ID NO: 29039 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
cccgcagtgataaaatagta

SEQ ID NO: 29040 - DNA, 20 bp, Artificial Sequence
  Description of Artificial Sequence: Synthetic oligonucleotide
  Target: ATXN1; (-) strand; PAM type: NNNNGHTT; PAM sequence: AAACGTTT
gggcttttataatgagtaga

SEQ ID NO: 29041 - DNA, 20 bp, Artificial Sequence
  Description of Artificial Sequence: Synthetic oligonucleotide
  Target: ATXN1; (-) strand; PAM type: NNNNGHTT; PAM sequence: TAGGGCTT
tattgtccatttggcgtttg

SEQ ID NO: 29042 - DNA, 20 bp, Artificial Sequence
  Description of Artificial Sequence: Synthetic oligonucleotide
  Target: ATXN1; (-) strand; PAM type: NNNNGHTT; PAM sequence: TGGCGTTT
gagcctgtttattgtccatt

SEQ ID NO: 29043 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
gagcctgcctttggggtgga

SEQ ID NO: 29044 - DNA, 20 bp, Artificial Sequence
  Description of Artificial Sequence: Synthetic oligonucleotide
  Target: ATXN1; (-) strand; PAM type: NNNNGHTT; PAM sequence: GGATGCTT
tgttgttcctatttttaatg

SEQ ID NO: 29045 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
ctcttatgcagttaaattgg

SEQ ID NO: 29046 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ttattgatttttgtatattc

SEQ ID NO: 29047 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
tggttgtcctttagaaaggt

SEQ ID NO: 29048 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gatcttgcatatagtcctcc

SEQ ID NO: 29049 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
ttagtagagacggcgtttta

SEQ ID NO: 29050 - DNA, 20 bp, Artificial Sequence
  Description of Artificial Sequence: Synthetic oligonucleotide
  Target: ATXN1; (-) strand; PAM type: NNNNGHTT; PAM sequence: CGGCGTTT
ttttgtatttttagtagaga

SEQ ID NO: 29051 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctctggctcccaggttc

SEQ ID NO: 29052 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
ttttttgaaatggggtttca

SEQ ID NO: 29053 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttttttttttttttgaaa

SEQ ID NO: 29054 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
taacattcttctttatgtag

SEQ ID NO: 29055 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
gtatttaacattcttcttta

SEQ ID NO: 29056 - DNA, 20 bp, Artificial Sequence
  Description of Artificial Sequence: Synthetic oligonucleotide
  Target: ATXN1; (-) strand; PAM type: NNNNGHTT; PAM sequence: ATAAGTTT
atttgtatttttgacatcat

SEQ ID NO: 29057 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
ttttccataggaacttcaga

SEQ ID NO: 29058 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
tcattgttatggccattctt

SEQ ID NO: 29059 - DNA, 20 bp, Artificial Sequence
  Description of Artificial Sequence: Synthetic oligonucleotide
  Target: ATXN1; (-) strand; PAM type: NNNNGHTT; PAM sequence: TAAGGCTT
atgcacactgttttactttc

SEQ ID NO: 29060 - DNA, 20 bp, Artificial Sequence
  Description of Artificial Sequence: Synthetic oligonucleotide
  Target: ATXN1; (-) strand; PAM type: NNNNGHTT; PAM sequence: CACTGTTT
agtattcctgtgcccatgca

SEQ ID NO: 29061 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
cgttcaaatctttggtcacc

SEQ ID NO: 29062 - DNA, 20 bp, Artificial Sequence
  Description of Artificial Sequence: Synthetic oligonucleotide
  Target: ATXN1; (-) strand; PAM type: NNNNGHTT; PAM sequence: TTATGCTT
caaggttctttctcatattt

SEQ ID NO: 29063 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
actgacttttccacttagcg

SEQ ID NO: 29064 - DNA, 20 bp, Artificial Sequence
  Description of Artificial Sequence: Synthetic oligonucleotide
  Target: ATXN1; (-) strand; PAM type: NNNNGHTT; PAM sequence: TATGGATT
cttaatctatgttttatctc

SEQ ID NO: 29065 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
gcccctggtatccacttaat

SEQ ID NO: 29066 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
acaatgcagtcttttaataa

SEQ ID NO: 29067 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
tgccttagccttctaaagtg

SEQ ID NO: 29068 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
ctggagtgcagtggtgcagt

SEQ ID NO: 29069 - DNA, 20 bp, Artificial Sequence
  Description of Artificial Sequence: Synthetic oligonucleotide
  Target: ATXN1; (-) strand; PAM type: NNNNGHTT; PAM sequence: ATATGATT
attaaaaaggttttattgag

SEQ ID NO: 29070 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
taaaagaaaataaaaattaa

SEQ ID NO: 29071 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tggaaggattgtttgagccc

SEQ ID NO: 29072 - DNA, 20 bp, Artificial Sequence
  Description of Artificial Sequence: Synthetic oligonucleotide
  Target: ATXN1; (-) strand; PAM type: NNNNGHTT; PAM sequence: GATTGTTT
tcgggaggctgaggtggaag

SEQ ID NO: 29073 - DNA, 20 bp, Artificial Sequence
  Description of Artificial Sequence: Synthetic oligonucleotide
  Target: ATXN1; (-) strand; PAM type: NNNNGHTT; PAM sequence: GAAGGATT
gtactcgggaggctgaggtg

SEQ ID NO: 29074 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
agccaaacatggtggcgcac

SEQ ID NO: 29075 - DNA, 20 bp, Artificial Sequence
  Description of Artificial Sequence: Synthetic oligonucleotide
  Target: ATXN1; (-) strand; PAM type: NNNNGHTT; PAM sequence: CCCTGTTT
gtctggacaacacagggaga

SEQ ID NO: 29076 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
tttattagtattttaaaaat

SEQ ID NO: 29077 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
tatttatcagatttttattt

SEQ ID NO: 29078 - DNA, 20 bp, Artificial Sequence
  Description of Artificial Sequence: Synthetic oligonucleotide
  Target: ATXN1; (-) strand; PAM type: NNNNGHTT; PAM sequence: ATCAGATT
aaattaaagtcatcttattt

SEQ ID NO: 29079 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
gactttatgttttcttcatg

SEQ ID NO: 29080 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
tttccgtttgtcttttgact

SEQ ID NO: 29081 - DNA, 20 bp, Artificial Sequence
  Description of Artificial Sequence: Synthetic oligonucleotide
  Target: ATXN1; (-) strand; PAM type: NNNNGHTT; PAM sequence: TTCCGTTT
tgctattttagtttaaattt

SEQ ID NO: 29082 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
gtccttttgtcttatgctat

SEQ ID NO: 29083 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
ttaggagcatgtaacagcta

SEQ ID NO: 29084 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
gcccatttttctactacgtt

SEQ ID NO: 29085 - DNA, 20 bp, Artificial Sequence
  Description of Artificial Sequence: Synthetic oligonucleotide
  Target: ATXN1; (-) strand; PAM type: NNNNGHTT; PAM sequence: CTACGTTT
cctcgttgcccatttttcta

SEQ ID NO: 29086 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
tggtggttgaatatactttc

SEQ ID NO: 29087 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
tatattctagtagctttaat

SEQ ID NO: 29088 - DNA, 20 bp, Artificial Sequence
  Description of Artificial Sequence: Synthetic oligonucleotide
  Target: ATXN1; (-) strand; PAM type: NNNNGHTT; PAM sequence: AGTAGCTT
ggtgaaaactactatattct

SEQ ID NO: 29089 - DNA, 20 bp, Artificial Sequence
  Description of Artificial Sequence: Synthetic oligonucleotide
  Target: ATXN1; (-) strand; PAM type: NNNNGHTT; PAM sequence: CGATGTTT
agtgtgcttttctccacaga

SEQ ID NO: 29090 - DNA, 20 bp, Artificial Sequence
  Description of Artificial Sequence: Synthetic oligonucleotide
  Target: ATXN1; (-) strand; PAM type: NNNNGHTT; PAM sequence: GTGTGCTT
ttcctgctagcactgtttga

SEQ ID NO: 29091 - DNA, 20 bp, Artificial Sequence
  Description of Artificial Sequence: Synthetic oligonucleotide
  Target: ATXN1; (-) strand; PAM type: NNNNGHTT; PAM sequence: CACTGTTT
ctattgtatgttcctgctag

SEQ ID NO: 29092 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
ttgttggatcaaaaggaata

SEQ ID NO: 29093 - DNA, 20 bp, Artificial Sequence
  Description of Artificial Sequence: Synthetic oligonucleotide
  Target: ATXN1; (-) strand; PAM type: NNNNGHTT; PAM sequence: CAATGCTT
cagtcacttgctactatgaa

SEQ ID NO: 29094 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
tggacttttttttttttttt

SEQ ID NO: 29095 - DNA, 20 bp, Artificial Sequence
  Description of Artificial Sequence: Synthetic oligonucleotide
  Target: ATXN1; (-) strand; PAM type: NNNNGHTT; PAM sequence: GTATGATT
tatctaaatagtattcgatt

SEQ ID NO: 29096 - DNA, 20 bp, Artificial Sequence
  Description of Artificial Sequence: Synthetic oligonucleotide
  Target: ATXN1; (-) strand; PAM type: NNNNGHTT; PAM sequence: ATTCGATT
ttttttagtatctaaatagt

SEQ ID NO: 29097 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
aaaatataggttttttaaaa

SEQ ID NO: 29098 - DNA, 20 bp, Artificial Sequence
  Description of Artificial Sequence: Synthetic oligonucleotide
  Target: ATXN1; (-) strand; PAM type: NNNNGHTT; PAM sequence: ATAGGTTT
atgattatataagcaaaaat

SEQ ID NO: 29099 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
tgagtccttttaaggatatt

SEQ ID NO: 29100 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
ctttctttttgaagcattaa

SEQ ID NO: 29101 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
atttcagtgtccttggtatg

SEQ ID NO: 29102 - DNA, 20 bp, Artificial Sequence
  Description of Artificial Sequence: Synthetic oligonucleotide
  Target: ATXN1; (-) strand; PAM type: NNNNGHTT; PAM sequence: GTATGCTT
tttatatttcagtgtccttg

SEQ ID NO: 29103 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
tttcctgggcagtcaatttt

SEQ ID NO: 29104 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
tctatttgggaaaagttgaa

SEQ ID NO: 29105 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
gcggtgcagacatgtgtaca

SEQ ID NO: 29106 - DNA, 20 bp, Artificial Sequence
  Description of Artificial Sequence: Synthetic oligonucleotide
  Target: ATXN1; (-) strand; PAM type: NNNNGHTT; PAM sequence: TGAAGATT
gggcaaatttgaatggatta

SEQ ID NO: 29107 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
tacaacagagggcaaatttg

SEQ ID NO: 29108 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
tcctgtcaggacatttttac

SEQ ID NO: 29109 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttgtatttttagtagaga

SEQ ID NO: 29110 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccgagtag

SEQ ID NO: 29111 - DNA, 20 bp, Artificial Sequence
  Description of Artificial Sequence: Synthetic oligonucleotide
  Target: ATXN1; (-) strand; PAM type: NNNNGHTT; PAM sequence: AAACGATT
caacctccgcctccccgttt

SEQ ID NO: 29112 - DNA, 20 bp, Artificial Sequence
  Description of Artificial Sequence: Synthetic oligonucleotide
  Target: ATXN1; (-) strand; PAM type: NNNNGHTT; PAM sequence: CCCCGTTT
gtgcactgcaacctccgcct

SEQ ID NO: 29113 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
ttttatttttatttttgagg

SEQ ID NO: 29114 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
tctgcaggagtggtagaatg

SEQ ID NO: 29115 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
gacaggcaaggtgaaaaacc

SEQ ID NO: 29116 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
cttcaagggaatcaaaaaag

SEQ ID NO: 29117 - DNA, 20 bp, Artificial Sequence
  Description of Artificial Sequence: Synthetic oligonucleotide
  Target: ATXN1; (-) strand; PAM type: NNNNGHTT; PAM sequence: GTAAGCTT
atggtcataattgggggaaa

SEQ ID NO: 29118 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
gggattacctgtgaatttca

SEQ ID NO: 29119 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
tatgtttgactaaaataaag

SEQ ID NO: 29120 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
attttgaagaggcaaggttg

SEQ ID NO: 29121 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
caaagaagaaaggaacaaga

SEQ ID NO: 29122 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
ttctttttattttatttttc

SEQ ID NO: 29123 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
atactggatacccaaggcat

SEQ ID NO: 29124 - DNA, 20 bp, Artificial Sequence
  Description of Artificial Sequence: Synthetic oligonucleotide
  Target: ATXN1; (-) strand; PAM type: NNNNGHTT; PAM sequence: TCAAGCTT
agggaaatattaaatgattc

SEQ ID NO: 29125 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
gatagttttagggaaatatt

SEQ ID NO: 29126 - DNA, 20 bp, Artificial Sequence
  Description of Artificial Sequence: Synthetic oligonucleotide
  Target: ATXN1; (-) strand; PAM type: NNNNGHTT; PAM sequence: GATAGTTT
caccattttgcagttaatca

SEQ ID NO: 29127 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
aaacacagtaaatattgtgt

SEQ ID NO: 29128 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
tgggacctttcttactttta

SEQ ID NO: 29129 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
ttttctgcttctgttgcatc

SEQ ID NO: 29130 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
cacctcaagctcccttggtt

SEQ ID NO: 29131 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
cctctcacacctcaagctcc

SEQ ID NO: 29132 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
ctaaccttactcattgcagc

SEQ ID NO: 29133 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
tgtgtataaccacttttctt

SEQ ID NO: 29134 - DNA, 20 bp, Artificial Sequence
  Description of Artificial Sequence: Synthetic oligonucleotide
  Target: ATXN1; (-) strand; PAM type: NNNNGHTT; PAM sequence: AGTAGATT
ttttcgtacttattcttaaa

SEQ ID NO: 29135 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
gtgagccactgcatcagcct

SEQ ID NO: 29136 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcggcctcccaaagtg

SEQ ID NO: 29137 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtattttttgtagagg

SEQ ID NO: 29138 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tttcttttcttttctttttc

SEQ ID NO: 29139 - DNA, 20 bp, Artificial Sequence
  Description of Artificial Sequence: Synthetic oligonucleotide
  Target: ATXN1; (-) strand; PAM type: NNNNGHTT; PAM sequence: GTAAGCTT
cctaagatggactcaaacta

SEQ ID NO: 29140 - DNA, 20 bp, Artificial Sequence
  Description of Artificial Sequence: Synthetic oligonucleotide
  Target: ATXN1; (-) strand; PAM type: NNNNGHTT; PAM sequence: TCCAGATT
catagtctgtgttctattca

SEQ ID NO: 29141 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
ctattctttctttaacctca

SEQ ID NO: 29142 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
tcacctaggttatctccctc

SEQ ID NO: 29143 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
cctctctaccctgacttctc

SEQ ID NO: 29144 - DNA, 20 bp, Artificial Sequence
  Description of Artificial Sequence: Synthetic oligonucleotide
  Target: ATXN1; (-) strand; PAM type: NNNNGHTT; PAM sequence: CCTCGTTT
ctccgcaaggctccaagacc

SEQ ID NO: 29145 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
ggtagaggaccatttattca

SEQ ID NO: 29146 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
gttaatctgaggagagtcat

SEQ ID NO: 29147 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
atgatccccatcacctgcac

SEQ ID NO: 29148 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
aagtttaactgtgcatgccc

SEQ ID NO: 29149 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
cagcctagacctcatggctt

SEQ ID NO: 29150 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
cccctaaccagcctagacct

SEQ ID NO: 29151 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
tgggcatagcctcctgaccc

SEQ ID NO: 29152 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
agacttcacctttccttcat

SEQ ID NO: 29153 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
gacccttctctctgccctgc

SEQ ID NO: 29154 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
agcggcgtcatggaccggtg

SEQ ID NO: 29155 - DNA, 20 bp, Artificial Sequence
  Description of Artificial Sequence: Synthetic oligonucleotide
  Target: ATXN1; (-) strand; PAM type: NNNNGHTT; PAM sequence: GTGAGCTT
agagaattctctttctattc

SEQ ID NO: 29156 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
agctgggatttggacccaca

SEQ ID NO: 29157 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cagctgaaaaggtagaagag

SEQ ID NO: 29158 - DNA, 20 bp, Artificial Sequence
  Description of Artificial Sequence: Synthetic oligonucleotide
  Target: ATXN1; (-) strand; PAM type: NNNNGHTT; PAM sequence: TGAGGTTT
ctcactttatagacgggggc

SEQ ID NO: 29159 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
taagcatcatgtatgtgtta

SEQ ID NO: 29160 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
tacctatctcactctcccaa

SEQ ID NO: 29161 - DNA, 20 bp, Artificial Sequence
  Description of Artificial Sequence: Synthetic oligonucleotide
  Target: ATXN1; (-) strand; PAM type: NNNNGHTT; PAM sequence: GTTCGCTT
ttttttcattttacacattt

SEQ ID NO: 29162 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
tagttacaaattaagattgt

SEQ ID NO: 29163 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
tacttttaggtagttacaaa

SEQ ID NO: 29164 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
tttccaagtttttgtgtaga

SEQ ID NO: 29165 - DNA, 20 bp, Artificial Sequence
  Description of Artificial Sequence: Synthetic oligonucleotide
  Target: ATXN1; (-) strand; PAM type: NNNNGHTT; PAM sequence: CCAAGTTT
gctgctatgaacattccttt

SEQ ID NO: 29166 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cattgtatggctatacctta

SEQ ID NO: 29167 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
ctgacttctttcacttagca

SEQ ID NO: 29168 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
agctgtttctctatatatag

SEQ ID NO: 29169 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
cacgaagctgtttctctata

SEQ ID NO: 29170 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
tcagctcctggcaaccacga

SEQ ID NO: 29171 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
ttaaaaaaaaaagtgcaatg

SEQ ID NO: 29172 - DNA, 20 bp, Artificial Sequence
  Description of Artificial Sequence: Synthetic oligonucleotide
  Target: ATXN1; (-) strand; PAM type: NNNNGHTT; PAM sequence: CATAGCTT
gcaggaggcattgaggactg

SEQ ID NO: 29173 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
ccctcacccagggaagaaag

SEQ ID NO: 29174 - DNA, 20 bp, Artificial Sequence
  Description of Artificial Sequence: Synthetic oligonucleotide
  Target: ATXN1; (-) strand; PAM type: NNNNGHTT; PAM sequence: AACTGCTT
ctgatattcataagtcaagg

SEQ ID NO: 29175 - DNA, 20 bp, Artificial Sequence
  Description of Artificial Sequence: Synthetic oligonucleotide
  Target: ATXN1; (-) strand; PAM type: NNNNGHTT; PAM sequence: CTAAGATT
ggggaaacagaatgcaggag

SEQ ID NO: 29176 - DNA, 20 bp, Artificial Sequence
  Description of Artificial Sequence: Synthetic oligonucleotide
  Target: ATXN1; (-) strand; PAM type: NNNNGHTT; PAM sequence: GATTGATT
gcctgtgaagataaagcaga

SEQ ID NO: 29177 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
tttcgcctgtgaagataaag

SEQ ID NO: 29178 - DNA, 20 bp, Artificial Sequence
  Description of Artificial Sequence: Synthetic oligonucleotide
  Target: ATXN1; (-) strand; PAM type: NNNNGHTT; PAM sequence: TAAAGCTT
tatgaaagacctgtccactt

SEQ ID NO: 29179 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
ggtggattggtttggaggac

SEQ ID NO: 29180 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
tgatgtggcctattaggtgg

SEQ ID NO: 29181 - DNA, 20 bp, Artificial Sequence
  Description of Artificial Sequence: Synthetic oligonucleotide
  Target: ATXN1; (-) strand; PAM type: NNNNGHTT; PAM sequence: GGTGGATT
caaaatgatgtggcctatta

SEQ ID NO: 29182 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
atttttcagtaatctctttt

SEQ ID NO: 29183 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
tcaaataaatagattatggg

SEQ ID NO: 29184 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
gataaatcaaacatcaaata

SEQ ID NO: 29185 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
actttttaggcaatattttg

SEQ ID NO: 29186 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
tggaagtaataatatgatgt

SEQ ID NO: 29187 - DNA, 20 bp, Artificial Sequence
  Description of Artificial Sequence: Synthetic oligonucleotide
  Target: ATXN1; (-) strand; PAM type: NNNNGHTT; PAM sequence: GGTTGATT
ctgttgatttttatggagaa

SEQ ID NO: 29188 - DNA, 20 bp, Artificial Sequence
  Description of Artificial Sequence: Synthetic oligonucleotide
  Target: ATXN1; (-) strand; PAM type: NNNNGHTT; PAM sequence: TGTTGATT
caacgttcctttaaaaacac

SEQ ID NO: 29189 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
tgcaaatgaataaattgtca

SEQ ID NO: 29190 - DNA, 20 bp, Artificial Sequence
  Description of Artificial Sequence: Synthetic oligonucleotide
  Target: ATXN1; (-) strand; PAM type: NNNNGHTT; PAM sequence: CTATGATT
tgtggaaattattattatta

SEQ ID NO: 29191 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
gtttctgttggtgtgcatgt

SEQ ID NO: 29192 - DNA, 20 bp, Artificial Sequence
  Description of Artificial Sequence: Synthetic oligonucleotide
  Target: ATXN1; (-) strand; PAM type: NNNNGHTT; PAM sequence: GGCAGTTT
tggaatgttcaaatagcaaa

SEQ ID NO: 29193 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
attttttgagcaatgttttc

SEQ ID NO: 29194 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
ttacctggaaattttttgag

SEQ ID NO: 29195 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
ttattaaccctagatattaa

SEQ ID NO: 29196 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
tagtaacctgttataaaaca

SEQ ID NO: 29197 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
ccggatgtgctttcctcagt

SEQ ID NO: 29198 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
ggctattttacacttgccgg

SEQ ID NO: 29199 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
tgatagtgcttggattcatt

SEQ ID NO: 29200 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
agttaacagttctgatagtg

SEQ ID NO: 29201 - DNA, 20 bp, Artificial Sequence
  Description of Artificial Sequence: Synthetic oligonucleotide
  Target: ATXN1; (-) strand; PAM type: NNNNGHTT; PAM sequence: TAGTGCTT
catgcagttaacagttctga

SEQ ID NO: 29202 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
tttttcacatagagatacat

SEQ ID NO: 29203 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
ttttatgacaagttggagtt

SEQ ID NO: 29204 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
atttatgttttatgacaagt

SEQ ID NO: 29205 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
agtcattaagtgtcacggat

SEQ ID NO: 29206 - DNA, 20 bp, Artificial Sequence
  Description of Artificial Sequence: Synthetic oligonucleotide
  Target: ATXN1; (-) strand; PAM type: NNNNGHTT; PAM sequence: CACGGATT
gattataagtcattaagtgt

SEQ ID NO: 29207 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
caaaaacatgaaatgttaat

SEQ ID NO: 29208 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
ctacaaaaaacatggtggta

SEQ ID NO: 29209 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
agaagttacaccaatgctgc

SEQ ID NO: 29210 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
gatcgcttgagcccaggagt

SEQ ID NO: 29211 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
cgggaggatcgcttgagccc

SEQ ID NO: 29212 - DNA, 20 bp, Artificial Sequence
  Description of Artificial Sequence: Synthetic oligonucleotide
  Target: ATXN1; (-) strand; PAM type: NNNNGHTT; PAM sequence: GATCGCTT
tctggaggctgaggcgggag

SEQ ID NO: 29213 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
aattggccaggcatggtgag

SEQ ID NO: 29214 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gcctgtttgtttgtttgttt

SEQ ID NO: 29215 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
cccagcctgtttgtttgttt

SEQ ID NO: 29216 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
cgcgcccagcctgtttgttt

SEQ ID NO: 29217 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
ccaccgcgcccagcctgttt

SEQ ID NO: 29218 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tgagccaccgcgcccagcct

SEQ ID NO: 29219 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
gtcgtgagccaccgcgccca

SEQ ID NO: 29220 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgccgtggcctcccaaagtg

SEQ ID NO: 29221 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttgtatttttagtagaga

SEQ ID NO: 29222 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tgcctcagcctcccgagtag

SEQ ID NO: 29223 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctttgcctcccagattc

SEQ ID NO: 29224 - DNA, 20 bp, Artificial Sequence
  Description of Artificial Sequence: Synthetic oligonucleotide
  Target: ATXN1; (-) strand; PAM type: NNNNGHTT; PAM sequence: CCCAGATT
gctcactgcaacctttgcct

SEQ ID NO: 29225 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
tttgttgttgttgttgttgt

SEQ ID NO: 29226 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
agtgaggacccacctctaca

SEQ ID NO: 29227 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
gaaagacaacttacgatgcc

SEQ ID NO: 29228 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
gcaaaaattgaactgcaaag

SEQ ID NO: 29229 - DNA, 20 bp, Artificial Sequence
  Description of Artificial Sequence: Synthetic oligonucleotide
  Target: ATXN1; (-) strand; PAM type: NNNNGHTT; PAM sequence: AAGGGTTT
taattgacaagtacctttga

SEQ ID NO: 29230 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
tcatagattccagatcacct

SEQ ID NO: 29231 - DNA, 20 bp, Artificial Sequence
  Description of Artificial Sequence: Synthetic oligonucleotide
  Target: ATXN1; (-) strand; PAM type: NNNNGHTT; PAM sequence: CATAGATT
atatccccccagattgtcct

SEQ ID NO: 29232 - DNA, 20 bp, Artificial Sequence
  Description of Artificial Sequence: Synthetic oligonucleotide
  Target: ATXN1; (-) strand; PAM type: NNNNGHTT; PAM sequence: CCCAGATT
tcagttggcagtcatatccc

SEQ ID NO: 29233 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
ctgtgagaataatttcaatg

SEQ ID NO: 29234 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
tgcattttgtggtatctttt

SEQ ID NO: 29235 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
catgtttaatggtctttccc

SEQ ID NO: 29236 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
taaaatttagtgaataccag

SEQ ID NO: 29237 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
agagttagattgtcagggtg

SEQ ID NO: 29238 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
gactatgcaagcttgtcaga

SEQ ID NO: 29239 - DNA, 20 bp, Artificial Sequence
  Description of Artificial Sequence: Synthetic oligonucleotide
  Target: ATXN1; (-) strand; PAM type: NNNNGHTT; PAM sequence: GCAAGCTT
aatagaatgcctaggactat

SEQ ID NO: 29240 - DNA, 20 bp, Artificial Sequence
  Description of Artificial Sequence: Synthetic oligonucleotide
  Target: ATXN1; (-) strand; PAM type: NNNNGHTT; PAM sequence: ATTAGATT
acaaaaatactcttgctgac

SEQ ID NO: 29241 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
accaatttgcagtttacaca

SEQ ID NO: 29242 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
tttgctctgtggaaccaatt

SEQ ID NO: 29243 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
acataattcatggattttat

SEQ ID NO: 29244 - DNA, 20 bp, Artificial Sequence
  Description of Artificial Sequence: Synthetic oligonucleotide
  Target: ATXN1; (-) strand; PAM type: NNNNGHTT; PAM sequence: CATGGATT
ttcaatacagagacataatt

SEQ ID NO: 29245 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
cataaaggtcctgagcattt

SEQ ID NO: 29246 - DNA, 20 bp, Artificial Sequence
  Description of Artificial Sequence: Synthetic oligonucleotide
  Target: ATXN1; (-) strand; PAM type: NNNNGHTT; PAM sequence: TGACGTTT
tttaaaggttaaaagagctc

SEQ ID NO: 29247 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
ctttgcaatataattactgt

SEQ ID NO: 29248 - DNA, 20 bp, Artificial Sequence
  Description of Artificial Sequence: Synthetic oligonucleotide
  Target: ATXN1; (-) strand; PAM type: NNNNGHTT; PAM sequence: ATAGGATT
tatctcccaatgtatcttta

SEQ ID NO: 29249 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
aatattcttgcgaattggaa

SEQ ID NO: 29250 - DNA, 20 bp, Artificial Sequence
  Description of Artificial Sequence: Synthetic oligonucleotide
  Target: ATXN1; (-) strand; PAM type: NNNNGHTT; PAM sequence: CAGCGTTT
tggagaaacattccctttgg

SEQ ID NO: 29251 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
cttaaaatttaatactctct

SEQ ID NO: 29252 - DNA, 20 bp, Artificial Sequence
  Description of Artificial Sequence: Synthetic oligonucleotide
  Target: ATXN1; (-) strand; PAM type: NNNNGHTT; PAM sequence: CTTCGTTT
ttatgtgtacttctctctgc

SEQ ID NO: 29253 - DNA, 20 bp, Artificial Sequence
  Description of Artificial Sequence: Synthetic oligonucleotide
  Target: ATXN1; (-) strand; PAM type: NNNNGHTT; PAM sequence: ATGGGCTT
tttatctctgctttatcaat

SEQ ID NO: 29254 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
aacctggagataacttttat

SEQ ID NO: 29255 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
tttctctgagaaaatgtgtt

SEQ ID NO: 29256 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
aacactgtttctctgagaaa

SEQ ID NO: 29257 - DNA, 20 bp, Artificial Sequence
  Description of Artificial Sequence: Synthetic oligonucleotide
  Target: ATXN1; (-) strand; PAM type: NNNNGHTT; PAM sequence: CACTGTTT
aaactaagcactatttataa

SEQ ID NO: 29258 - DNA, 20 bp, Artificial Sequence
  Description of Artificial Sequence: Synthetic oligonucleotide
  Target: ATXN1; (-) strand; PAM type: NNNNGHTT; PAM sequence: TAGAGTTT
ctgtcccctgctcatggtac

SEQ ID NO: 29259 - DNA, 20 bp, Artificial Sequence
  Description of Artificial Sequence: Synthetic oligonucleotide
  Target: ATXN1; (-) strand; PAM type: NNNNGHTT; PAM sequence: TCATGATT
tttgtaagtcacccacctcc

SEQ ID NO: 29260 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
tgccagaaaaaaaaaacttt

SEQ ID NO: 29261 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
agataactggacttgggaag

SEQ ID NO: 29262 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
gaactgaactctttattagc

SEQ ID NO: 29263 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
catgtccccattcctctctc

SEQ ID NO: 29264 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
tcattctttgtgtgtatacc

SEQ ID NO: 29265 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tcttaggagctgggtcctgt

SEQ ID NO: 29266 - DNA, 20 bp, Artificial Sequence
  Description of Artificial Sequence: Synthetic oligonucleotide
  Target: ATXN1; (-) strand; PAM type: NNNNGHTT; PAM sequence: ACCTGCTT
tctatacctgttggtcagga

SEQ ID NO: 29267 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
caccttggcctcccaaagtg

SEQ ID NO: 29268 - DNA, 20 bp, Artificial Sequence
  Description of Artificial Sequence: Synthetic oligonucleotide
  Target: ATXN1; (-) strand; PAM type: NNNNGHTT; PAM sequence: CGAGGTTT
ttttttatttttagcagaga

SEQ ID NO: 29269 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
tgtcttagcctccccagtag

SEQ ID NO: 29270 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
agcctccacctcctgggttc

SEQ ID NO: 29271 - DNA, 20 bp, Artificial Sequence
  Description of Artificial Sequence: Synthetic oligonucleotide
  Target: ATXN1; (-) strand; PAM type: NNNNGHTT; PAM sequence: GTGAGCTT
ccaggctggagtgcagtggt

SEQ ID NO: 29272 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
gagaccactgagtcaatcgg

SEQ ID NO: 29273 - DNA, 20 bp, Artificial Sequence
  Description of Artificial Sequence: Synthetic oligonucleotide
  Target: ATXN1; (-) strand; PAM type: NNNNGHTT; PAM sequence: CCGAGATT
tactcccatcccagccccac

SEQ ID NO: 29274 - DNA, 20 bp, Artificial Sequence
  Description of Artificial Sequence: Synthetic oligonucleotide
  Target: ATXN1; (-) strand; PAM type: NNNNGHTT; PAM sequence: ACCAGTTT
aactgttttttcaacaacta

SEQ ID NO: 29275 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
tatgtcaaggagtacaggga

SEQ ID NO: 29276 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
agagagtgagcagtctcctg

SEQ ID NO: 29277 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
tggagagggcgtctgtatgg

SEQ ID NO: 29278 - DNA, 20 bp, Artificial Sequence
  Description of Artificial Sequence: Synthetic oligonucleotide
  Target: ATXN1; (-) strand; PAM type: NNNNGHTT; PAM sequence: AGTGGATT
gtttgaggacaaacaaacct

SEQ ID NO: 29279 - DNA, 20 bp, Artificial Sequence
  Description of Artificial Sequence: Synthetic oligonucleotide
  Target: ATXN1; (-) strand; PAM type: NNNNGHTT; PAM sequence: TTTCGTTT
atctcagcggtgtgaggcca

SEQ ID NO: 29280 - DNA, 20 bp, Artificial Sequence
  Description of Artificial Sequence: Synthetic oligonucleotide
  Target: ATXN1; (-) strand; PAM type: NNNNGHTT; PAM sequence: GAGGGCTT
aaatagattagaaggaataa

SEQ ID NO: 29281 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
ttcacttcttcagtttccca

SEQ ID NO: 29282 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
tgattcaacacattcacttc

SEQ ID NO: 29283 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
aaggacactcaaagtaagat

SEQ ID NO: 29284 - DNA, 20 bp, Artificial Sequence
  Description of Artificial Sequence: Synthetic oligonucleotide
  Target: ATXN1; (-) strand; PAM type: NNNNGHTT; PAM sequence: GTAAGATT
gactcacaaggacactcaaa

SEQ ID NO: 29285 - DNA, 20 bp, Artificial Sequence
  Description of Artificial Sequence: Synthetic oligonucleotide
  Target: ATXN1; (-) strand; PAM type: NNNNGHTT; PAM sequence: CATGGATT
agttcacttggtgccacttc

SEQ ID NO: 29286 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
gtgaatgaatgaagtgagca

SEQ ID NO: 29287 - DNA, 20 bp, Artificial Sequence
  Description of Artificial Sequence: Synthetic oligonucleotide
  Target: ATXN1; (-) strand; PAM type: NNNNGHTT; PAM sequence: CTTAGTTT
catttcaaattacatcttaa

SEQ ID NO: 29288 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
caagggtagaaagctagggt

SEQ ID NO: 29289 - DNA, 20 bp, Artificial Sequence
  Description of Artificial Sequence: Synthetic oligonucleotide
  Target: ATXN1; (-) strand; PAM type: NNNNGHTT; PAM sequence: TAGGGTTT
aaggagcaagggtagaaagc

SEQ ID NO: 29290 - DNA, 20 bp, Artificial Sequence
  Description of Artificial Sequence: Synthetic oligonucleotide
  Target: ATXN1; (-) strand; PAM type: NNNNGHTT; PAM sequence: CCATGCTT
ataaggattgggaaatcagg

SEQ ID NO: 29291 - DNA, 20 bp, Artificial Sequence
  Description of Artificial Sequence: Synthetic oligonucleotide
  Target: ATXN1; (-) strand; PAM type: NNNNGHTT; PAM sequence: TAAGGATT
taaccctcaacagagctcca

SEQ ID NO: 29292 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tgcattcaatacaatagctg

SEQ ID NO: 29293 - DNA, 20 bp, Artificial Sequence
  Description of Artificial Sequence: Synthetic oligonucleotide
  Target: ATXN1; (-) strand; PAM type: NNNNGHTT; PAM sequence: ATGGGCTT
gtagcctctagattcccttt

SEQ ID NO: 29294 - DNA, 20 bp, Artificial Sequence
  Description of Artificial Sequence: Synthetic oligonucleotide
  Target: ATXN1; (-) strand; PAM type: NNNNGHTT; PAM sequence: TCTAGATT
gaatactccatgaagtagcc

SEQ ID NO: 29295 - DNA, 20 bp, Artificial Sequence
  Description of Artificial Sequence: Synthetic oligonucleotide
  Target: ATXN1; (-) strand; PAM type: NNNNGHTT; PAM sequence: CTATGATT
gagttcaaggttacagtgag

SEQ ID NO: 29296 - DNA, 20 bp, Artificial Sequence
  Description of Artificial Sequence: Synthetic oligonucleotide
  Target: ATXN1; (-) strand; PAM type: NNNNGHTT; PAM sequence: GATTGCTT
tcaggaggctgaggtgggag

SEQ ID NO: 29297 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
ctgctcaggaggctgaggtg

SEQ ID NO: 29298 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
cagaacaagtctttgtctct

SEQ ID NO: 29299 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
taggaggatcacttgagtct

SEQ ID NO: 29300 - DNA, 20 bp, Artificial Sequence
  Description of Artificial Sequence: Synthetic oligonucleotide
  Target: ATXN1; (-) strand; PAM type: NNNNGHTT; PAM sequence: GGAGGCTT
cctgtagtcctagctacttg

SEQ ID NO: 29301 - DNA, 20 bp, Artificial Sequence
  Description of Artificial Sequence: Synthetic oligonucleotide
  Target: ATXN1; (-) strand; PAM type: NNNNGHTT; PAM sequence: ACGAGTTT
tggaaggatcacttgaagcc

SEQ ID NO: 29302 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
ttgcacgatataatatgaat

SEQ ID NO: 29303 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
tatagttaattgtaagtgga

SEQ ID NO: 29304 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
tctcagtcaacattatacat

SEQ ID NO: 29305 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
atgggtggcagtaatcagat

SEQ ID NO: 29306 - DNA, 20 bp, Artificial Sequence
  Description of Artificial Sequence: Synthetic oligonucleotide
  Target: ATXN1; (-) strand; PAM type: NNNNGHTT; PAM sequence: ATCAGATT
tttgattatgggtggcagta

SEQ ID NO: 29307 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
tggaagacttagacatacac

SEQ ID NO: 29308 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
ggtttctgtagcctttatac

SEQ ID NO: 29309 - DNA, 20 bp, Artificial Sequence
  Description of Artificial Sequence: Synthetic oligonucleotide
  Target: ATXN1; (-) strand; PAM type: NNNNGHTT; PAM sequence: AAGGGTTT
tcactctgtgttgggtagga

SEQ ID NO: 29310 - DNA, 20 bp, Artificial Sequence
  Description of Artificial Sequence: Synthetic oligonucleotide
  Target: ATXN1; (-) strand; PAM type: NNNNGHTT; PAM sequence: TTGGGCTT
tgtgttctttttgttttctc

SEQ ID NO: 29311 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ggctggctttgctgtgttct

SEQ ID NO: 29312 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
caccctgaagtcatgctctg

SEQ ID NO: 29313 - DNA, 20 bp, Artificial Sequence
  Description of Artificial Sequence: Synthetic oligonucleotide
  Target: ATXN1; (-) strand; PAM type: NNNNGHTT; PAM sequence: GCATGCTT
aaaaaacagaaaaagtgtat

SEQ ID NO: 29314 - DNA, 20 bp, Artificial Sequence
  Description of Artificial Sequence: Synthetic oligonucleotide
  Target: ATXN1; (-) strand; PAM type: NNNNGHTT; PAM sequence: GAAAGATT
ccctccacataaaaagaagg

SEQ ID NO: 29315 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
ggaatgtgggccagaaagcc

SEQ ID NO: 29316 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
aaaaagaatgtcaacacagc

SEQ ID NO: 29317 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
aatgtattctaggtgaggaa

SEQ ID NO: 29318 - DNA, 20 bp, Artificial Sequence
  Description of Artificial Sequence: Synthetic oligonucleotide
  Target: ATXN1; (-) strand; PAM type: NNNNGHTT; PAM sequence: AGATGATT
aatggagaggaaggagtcaa

SEQ ID NO: 29319 - DNA, 20 bp, Artificial Sequence
  Description of Artificial Sequence: Synthetic oligonucleotide
  Target: ATXN1; (-) strand; PAM type: NNNNGHTT; PAM sequence: GTTGGATT
aataatataacttagtaatt

SEQ ID NO: 29320 - DNA, 20 bp, Artificial Sequence
  Description of Artificial Sequence: Synthetic oligonucleotide
  Target: ATXN1; (-) strand; PAM type: NNNNGHTT; PAM sequence: ATTCGTTT
aagataggtaatgggagcct

SEQ ID NO: 29321 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
ttgtttatggaaggggctca

SEQ ID NO: 29322 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
ggtgacacagagttcccagt

SEQ ID NO: 29323 - DNA, 20 bp, Artificial Sequence
  Description of Artificial Sequence: Synthetic oligonucleotide
  Target: ATXN1; (-) strand; PAM type: NNNNGHTT; PAM sequence: TGGAGATT
cggagttatatgtgcattgc

SEQ ID NO: 29324 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
tggggattggagtcttcagg

SEQ ID NO: 29325 - DNA, 20 bp, Artificial Sequence
  Description of Artificial Sequence: Synthetic oligonucleotide
  Target: ATXN1; (-) strand; PAM type: NNNNGHTT; PAM sequence: TGGGGATT
gaagaggaatgagaaatggc

SEQ ID NO: 29326 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
ttgggaggctgaggcaagag

SEQ ID NO: 29327 - DNA, 20 bp, Artificial Sequence
  Description of Artificial Sequence: Synthetic oligonucleotide
  Target: ATXN1; (-) strand; PAM type: NNNNGHTT; PAM sequence: CCCCGTTT
ccctgagcaacatggagaaa

SEQ ID NO: 29328 - DNA, 20 bp, Artificial Sequence
  Description of Artificial Sequence: Synthetic oligonucleotide
  Target: ATXN1; (-) strand; PAM type: NNNNGHTT; PAM sequence: TGCCGCTT
agggagctctgtactatttt

SEQ ID NO: 29329 - DNA, 20 bp, Artificial Sequence
  Description of Artificial Sequence: Synthetic oligonucleotide
  Target: ATXN1; (-) strand; PAM type: NNNNGHTT; PAM sequence: TATGGCTT
tctagttttgatcgtggttc

SEQ ID NO: 29330 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
gtcgtgacccaggttaactt

SEQ ID NO: 29331 - DNA, 20 bp, Artificial Sequence
  Description of Artificial Sequence: Synthetic oligonucleotide
  Target: ATXN1; (-) strand; PAM type: NNNNGHTT; PAM sequence: TACGGTTT
ggtgaaatcctaatacaccc

SEQ ID NO: 29332 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
acaggaaaaaaaaaaaaaaa

SEQ ID NO: 29333 - DNA, 20 bp, Artificial Sequence
  Description of Artificial Sequence: Synthetic oligonucleotide
  Target: ATXN1; (-) strand; PAM type: NNNNGHTT; PAM sequence: CACAGATT
aggaaggattcaggaactgt

SEQ ID NO: 29334 - DNA, 20 bp, Artificial Sequence
  Description of Artificial Sequence: Synthetic oligonucleotide
  Target: ATXN1; (-) strand; PAM type: NNNNGHTT; PAM sequence: GAAGGATT
tcaaggtctttaaggataag

SEQ ID NO: 29335 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
gtaattacaaggagaaaaat

SEQ ID NO: 29336 - DNA, 20 bp, Artificial Sequence
  Description of Artificial Sequence: Synthetic oligonucleotide
  Target: ATXN1; (-) strand; PAM type: NNNNGHTT; PAM sequence: GATGGATT
agatgggcagatgtggatta

SEQ ID NO: 29337 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
ggatgcattagatgggcaga

SEQ ID NO: 29338 - DNA, 20 bp, Artificial Sequence
  Description of Artificial Sequence: Synthetic oligonucleotide
  Target: ATXN1; (-) strand; PAM type: NNNNGHTT; PAM sequence: GCTGGATT
aactgggtaaggaaataaat

SEQ ID NO: 29339 - DNA, 20 bp, Artificial Sequence
  Description of Artificial Sequence: Synthetic oligonucleotide
  Target: ATXN1; (-) strand; PAM type: NNNNGHTT; PAM sequence: TACAGCTT
gaaatggtagaatatctagc

SEQ ID NO: 29340 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
gtaaaccactcggacagagg

SEQ ID NO: 29341 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
ttttctccaggtagagttga

SEQ ID NO: 29342 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
acaatagaagggaagcagga

SEQ ID NO: 29343 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
ctctagaaattttatatgcc

SEQ ID NO: 29344 - DNA, 20 bp, Artificial Sequence
  Description of Artificial Sequence: Synthetic oligonucleotide
  Target: ATXN1; (-) strand; PAM type: NNNNGHTT; PAM sequence: AGGGGCTT
ggaattagtttagaagattc

SEQ ID NO: 29345 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
ttgatgtggggaattagttt

SEQ ID NO: 29346 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
cttgaggtttgatgtgggga

SEQ ID NO: 29347 - DNA, 20 bp, Artificial Sequence
  Description of Artificial Sequence: Synthetic oligonucleotide
  Target: ATXN1; (-) strand; PAM type: NNNNGHTT; PAM sequence: TGAGGTTT
cttcctaaatagtgtgccct

SEQ ID NO: 29348 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
atagtcactatataaagagt

SEQ ID NO: 29349 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
gatttttttttttttacctt

SEQ ID NO: 29350 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
tggattaagacaaatgactt

SEQ ID NO: 29351 - DNA, 20 bp, Artificial Sequence
  Description of Artificial Sequence: Synthetic oligonucleotide
  Target: ATXN1; (-) strand; PAM type: NNNNGHTT; PAM sequence: ACTGGATT
cgatgaaattggatttgaag

SEQ ID NO: 29352 - DNA, 20 bp, Artificial Sequence
  Description of Artificial Sequence: Synthetic oligonucleotide
  Target: ATXN1; (-) strand; PAM type: NNNNGHTT; PAM sequence: ATTGGATT
gaaggaataaaaacgatgaa

SEQ ID NO: 29353 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
tcatatgtagaaaagaacag

SEQ ID NO: 29354 - DNA, 20 bp, Artificial Sequence
  Description of Artificial Sequence: Synthetic oligonucleotide
  Target: ATXN1; (-) strand; PAM type: NNNNGHTT; PAM sequence: AACAGCTT
aactatcatatgtagaaaag

SEQ ID NO: 29355 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gcagaaaatatgcccccact

SEQ ID NO: 29356 - DNA, 20 bp, Artificial Sequence
  Description of Artificial Sequence: Synthetic oligonucleotide
  Target: ATXN1; (-) strand; PAM type: NNNNGHTT; PAM sequence: CACTGTTT
tgtggcagaaaatatgcccc

SEQ ID NO: 29357 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
ctttgcttgcttggaattga

SEQ ID NO: 29358 - DNA, 20 bp, Artificial Sequence
  Description of Artificial Sequence: Synthetic oligonucleotide
  Target: ATXN1; (-) strand; PAM type: NNNNGHTT; PAM sequence: GCTTGCTT
tgtattttccttgtgtcttt

SEQ ID NO: 29359 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
gcagtgtattttccttgtgt

SEQ ID NO: 29360 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
agtgtcaataagtgtctgaa

SEQ ID NO: 29361 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
atagtaggagttacatatta

SEQ ID NO: 29362 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
aacattatatgtgcaggaga

SEQ ID NO: 29363 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
gggggttactctgtgtgcat

SEQ ID NO: 29364 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
aggaagtcaactggccttta

SEQ ID NO: 29365 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
gaagtgtctacttgtctttt

SEQ ID NO: 29366 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
tgcatcagcccatctgtctc

SEQ ID NO: 29367 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
ccaccgtgcccggccaaacc

SEQ ID NO: 29368 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
ctcctcggcctcccaaaggg

SEQ ID NO: 29369 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttagtagaga

SEQ ID NO: 29370 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
ggttcaagcaatccttttgc

SEQ ID NO: 29371 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
tctctgttaagcggtaaacc

SEQ ID NO: 29372 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
tttctggctcagaaattctt

SEQ ID NO: 29373 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
aaattcatatgaattatttt

SEQ ID NO: 29374 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
agacagtaatcacatgtgga

SEQ ID NO: 29375 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
caaatgagataatgcattga

SEQ ID NO: 29376 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
agggaaatcactcaaaatct

SEQ ID NO: 29377 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
gaatctcagttctgcaactt

SEQ ID NO: 29378 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
tgaaatacaatatcagaaat

SEQ ID NO: 29379 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
gtttcatttagaagcacata

SEQ ID NO: 29380 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
aaaaatttagagattaaaga

SEQ ID NO: 29381 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
tagaacgttaccaaaaaatt

SEQ ID NO: 29382 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
tgataagggaacctgggcat

SEQ ID NO: 29383 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
gaacatcatatctctcaaaa

SEQ ID NO: 29384 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
acagtttttaaaaagcaaaa

SEQ ID NO: 29385 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
tactcagcaatatgtgcagc

SEQ ID NO: 29386 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
tgagtacaaatgtagaactc

SEQ ID NO: 29387 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
ggaataacagtgacagagaa

SEQ ID NO: 29388 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
ctgaccagaaaggaaaactc

SEQ ID NO: 29389 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
tgtcccattgatctatcgtc

SEQ ID NO: 29390 - DNA, 20 bp, Artificial Sequence
  Description of Artificial Sequence: Synthetic oligonucleotide
  Target: ATXN1; (-) strand; PAM type: NNNNGHTT; PAM sequence: GGGGGCTT
cctacacacaccccaaaaag

SEQ ID NO: 29391 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
tttgccccaaagtctgactg

SEQ ID NO: 29392 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
attgggcaataagatgggag

SEQ ID NO: 29393 - DNA, 20 bp, Artificial Sequence
  Description of Artificial Sequence: Synthetic oligonucleotide
  Target: ATXN1; (-) strand; PAM type: NNNNGHTT; PAM sequence: AGCAGATT
aaaaggagtgagacagaaat

SEQ ID NO: 29394 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
tcaagctgcagtacttatat

SEQ ID NO: 29395 - DNA, 20 bp, Artificial Sequence
  Description of Artificial Sequence: Synthetic oligonucleotide
  Target: ATXN1; (-) strand; PAM type: NNNNGHTT; PAM sequence: AGATGCTT
cacaaaggcaaccctcttcc

SEQ ID NO: 29396 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
tgcattttagtggctgcata

SEQ ID NO: 29397 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
ctatgaaaagcggtcactgt

SEQ ID NO: 29398 - DNA, 20 bp, Artificial Sequence
  Description of Artificial Sequence: Synthetic oligonucleotide
  Target: ATXN1; (-) strand; PAM type: NNNNGHTT; PAM sequence: CACTGTTT
aagaacctatgaaaagcggt

SEQ ID NO: 29399 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
ttaccatcattttgcaacct

SEQ ID NO: 29400 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
aacatgagtggtttgctctc

SEQ ID NO: 29401 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
agttctccatctgtaacatg

SEQ ID NO: 29402 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
gaccaaggtactcagtgacc

SEQ ID NO: 29403 - DNA, 20 bp, Artificial Sequence
  Description of Artificial Sequence: Synthetic oligonucleotide
  Target: ATXN1; (-) strand; PAM type: NNNNGHTT; PAM sequence: GGGGGCTT
tgaatcggcgggtggggggg

SEQ ID NO: 29404 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
gtgtgctttagaagctgggt

SEQ ID NO: 29405 - DNA, 20 bp, Artificial Sequence
  Description of Artificial Sequence: Synthetic oligonucleotide
  Target: ATXN1; (-) strand; PAM type: NNNNGHTT; PAM sequence: GTGTGCTT
aagaattcagtgctgatgcc

SEQ ID NO: 29406 - DNA, 20 bp, Artificial Sequence
  Description of Artificial Sequence: Synthetic oligonucleotide
  Target: ATXN1; (-) strand; PAM type: NNNNGHTT; PAM sequence: TGGAGATT
caccctgtattttttcctgg

SEQ ID NO: 29407 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tggcaattatatgctgtccc

SEQ ID NO: 29408 - DNA, 20 bp, Artificial Sequence
  Description of Artificial Sequence: Synthetic oligonucleotide
  Target: ATXN1; (-) strand; PAM type: NNNNGHTT; PAM sequence: GGTAGTTT
gttttagtaaaatttgggaa

SEQ ID NO: 29409 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
taattttttagatttttgct

SEQ ID NO: 29410 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
aagtatatcactggtaattt

SEQ ID NO: 29411 - DNA, 20 bp, Artificial Sequence
  Description of Artificial Sequence: Synthetic oligonucleotide
  Target: ATXN1; (-) strand; PAM type: NNNNGHTT; PAM sequence: ATAAGATT
tgattgttgaaacaactgtt

SEQ ID NO: 29412 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
caaatagtgaatcattcatt

SEQ ID NO: 29413 - DNA, 20 bp, Artificial Sequence
  Description of Artificial Sequence: Synthetic oligonucleotide
  Target: ATXN1; (-) strand; PAM type: NNNNGHTT; PAM sequence: TAGTGCTT
ctgtgctccctgaatatcat

SEQ ID NO: 29414 - DNA, 20 bp, Artificial Sequence
  Description of Artificial Sequence: Synthetic oligonucleotide
  Target: ATXN1; (-) strand; PAM type: NNNNGHTT; PAM sequence: ATAGGATT
ataggagagcttttgacatt

SEQ ID NO: 29415 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
aattcaggaatgtgagatag

SEQ ID NO: 29416 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
aaatgaaatgaagcatttaa

SEQ ID NO: 29417 - DNA, 20 bp, Artificial Sequence
  Description of Artificial Sequence: Synthetic oligonucleotide
  Target: ATXN1; (-) strand; PAM type: NNNNGHTT; PAM sequence: TACAGCTT
aggtagaaatccaactttca

SEQ ID NO: 29418 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
accttcccctgctacactaa

SEQ ID NO: 29419 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
cattagaaaatggttgatat

SEQ ID NO: 29420 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
aaggtagactattccatcat

SEQ ID NO: 29421 - DNA, 20 bp, Artificial Sequence
  Description of Artificial Sequence: Synthetic oligonucleotide
  Target: ATXN1; (-) strand; PAM type: NNNNGHTT; PAM sequence: ATATGATT
ctttgaaagttttataaata

SEQ ID NO: 29422 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
tatgaagcattttattcttt

SEQ ID NO: 29423 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
taaagttttaaaataactta

SEQ ID NO: 29424 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
ttaaactattttggatactt

SEQ ID NO: 29425 - DNA, 20 bp, Artificial Sequence
  Description of Artificial Sequence: Synthetic oligonucleotide
  Target: ATXN1; (-) strand; PAM type: NNNNGHTT; PAM sequence: CGTAGCTT
tattgtgttttatatgtagg

SEQ ID NO: 29426 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
gtcaaagattcaagagtata

SEQ ID NO: 29427 - DNA, 20 bp, Artificial Sequence
  Description of Artificial Sequence: Synthetic oligonucleotide
  Target: ATXN1; (-) strand; PAM type: NNNNGHTT; PAM sequence: CAAAGATT
aaagcgaaaaaatgtagggt

SEQ ID NO: 29428 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
aggcattattttgagacatt

SEQ ID NO: 29429 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
gatagcctccataattcata

SEQ ID NO: 29430 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
cccgcccctcagctcttagg

SEQ ID NO: 29431 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
atccaccacgtactctaccc

SEQ ID NO: 29432 - DNA, 20 bp, Artificial Sequence
  Description of Artificial Sequence: Synthetic oligonucleotide
  Target: ATXN1; (-) strand; PAM type: NNNNGHTT; PAM sequence: TTCGGATT
gtaaaggctgcatttttagc

SEQ ID NO: 29433 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
catttggtaaaggctgcatt

SEQ ID NO: 29434 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
cttaaataacaggctctgct

SEQ ID NO: 29435 - DNA, 20 bp, Artificial Sequence
  Description of Artificial Sequence: Synthetic oligonucleotide
  Target: ATXN1; (-) strand; PAM type: NNNNGHTT; PAM sequence: GGGTGCTT
accttcctccctccattcct

SEQ ID NO: 29436 - DNA, 20 bp, Artificial Sequence
  Description of Artificial Sequence: Synthetic oligonucleotide
  Target: ATXN1; (-) strand; PAM type: NNNNGHTT; PAM sequence: GTGGGATT
ccttccactcagcattgttt

SEQ ID NO: 29437 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
tttggtacccttccactcag

SEQ ID NO: 29438 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
actttatttagttcacttta

SEQ ID NO: 29439 - DNA, 20 bp, Artificial Sequence
  Description of Artificial Sequence: Synthetic oligonucleotide
  Target: ATXN1; (-) strand; PAM type: NNNNGHTT; PAM sequence: GTGAGATT
actataattcacctcagaga

SEQ ID NO: 29440 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
accgtgtctttatcacagta

SEQ ID NO: 29441 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
gtcagggactgacaatgagg

SEQ ID NO: 29442 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
atacagtcaacaccatcata

SEQ ID NO: 29443 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
tgacaaaagactggccctaa

SEQ ID NO: 29444 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
attgaagataatggaggaaa

SEQ ID NO: 29445 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
catggggactttggggtgtc

SEQ ID NO: 29446 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
atctgtggtcagcagttttt

SEQ ID NO: 29447 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
gtgacctcagatctgtggtc

SEQ ID NO: 29448 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
atgcagacgtgttggttgtc

SEQ ID NO: 29449 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
ataaagactcagagaggaag

SEQ ID NO: 29450 - DNA, 20 bp, Artificial Sequence
  Description of Artificial Sequence: Synthetic oligonucleotide
  Target: ATXN1; (-) strand; PAM type: NNNNGHTT; PAM sequence: CTTAGCTT
catttggtatttgaatagca

SEQ ID NO: 29451 - DNA, 20 bp, Artificial Sequence
  Description of Artificial Sequence: Synthetic oligonucleotide
  Target: ATXN1; (-) strand; PAM type: NNNNGHTT; PAM sequence: GCCAGATT
aaaagagttcataatgttct

SEQ ID NO: 29452 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
ggatgaataagaaaacaaaa

SEQ ID NO: 29453 - DNA, 20 bp, Artificial Sequence
  Description of Artificial Sequence: Synthetic oligonucleotide
  Target: ATXN1; (-) strand; PAM type: NNNNGHTT; PAM sequence: GTTAGCTT
tgaattcctaattaagacat

SEQ ID NO: 29454 - DNA, 20 bp, Artificial Sequence
  Description of Artificial Sequence: Synthetic oligonucleotide
  Target: ATXN1; (-) strand; PAM type: NNNNGHTT; PAM sequence: ATTCGTTT
cttgtgtatgtagacgctgc

SEQ ID NO: 29455 - DNA, 20 bp, Artificial Sequence
  Description of Artificial Sequence: Synthetic oligonucleotide
  Target: ATXN1; (-) strand; PAM type: NNNNGHTT; PAM sequence: ATGAGCTT
ctttcactggttaccctgct

SEQ ID NO: 29456 - DNA, 20 bp, Artificial Sequence
  Description of Artificial Sequence: Synthetic oligonucleotide
  Target: ATXN1; (-) strand; PAM type: NNNNGHTT; PAM sequence: TACGGCTT
gacaaacacagaacgacgtg

SEQ ID NO: 29457 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
gatgcatgaaggggaaggct

SEQ ID NO: 29458 - DNA, 20 bp, Artificial Sequence
  Description of Artificial Sequence: Synthetic oligonucleotide
  Target: ATXN1; (-) strand; PAM type: NNNNGHTT; PAM sequence: GCATGCTT
acacccagctcttaggaaac

SEQ ID NO: 29459 - DNA, 20 bp, Artificial Sequence
  Description of Artificial Sequence: Synthetic oligonucleotide
  Target: ATXN1; (-) strand; PAM type: NNNNGHTT; PAM sequence: ATAAGCTT
tctcttcccgtcattactaa

SEQ ID NO: 29460 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
gagcagccgttgggtgagag

SEQ ID NO: 29461 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
agtcagagacccatttttca

SEQ ID NO: 29462 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
tcctggagagacttcctgat

SEQ ID NO: 29463 - DNA, 20 bp, Artificial Sequence
  Description of Artificial Sequence: Synthetic oligonucleotide
  Target: ATXN1; (-) strand; PAM type: NNNNGHTT; PAM sequence: TCCTGATT
atcccagtcctggagagact

SEQ ID NO: 29464 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
aagggtttagcatacttctg

SEQ ID NO: 29465 - DNA, 20 bp, Artificial Sequence
  Description of Artificial Sequence: Synthetic oligonucleotide
  Target: ATXN1; (-) strand; PAM type: NNNNGHTT; PAM sequence: AAGGGTTT
cctcctctagtatctacaaa

SEQ ID NO: 29466 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
tgctgcaaataatatatatg

SEQ ID NO: 29467 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
ctgggctcaaattccagctc

SEQ ID NO: 29468 - DNA, 20 bp, Artificial Sequence
  Description of Artificial Sequence: Synthetic oligonucleotide
  Target: ATXN1; (-) strand; PAM type: NNNNGHTT; PAM sequence: GCAAGCTT
gaaaagctgtagataagatt

SEQ ID NO: 29469 - DNA, 20 bp, Artificial Sequence
  Description of Artificial Sequence: Synthetic oligonucleotide
  Target: ATXN1; (-) strand; PAM type: NNNNGHTT; PAM sequence: ATAAGATT
atatgatggaaaagctgtag

SEQ ID NO: 29470 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
atatatgtccaatatcggga

SEQ ID NO: 29471 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
tatctgaagttatactgctc

SEQ ID NO: 29472 - DNA, 20 bp, Artificial Sequence
  Description of Artificial Sequence: Synthetic oligonucleotide
  Target: ATXN1; (-) strand; PAM type: NNNNGHTT; PAM sequence: ACCAGATT
cagcagcatccttgaaactt

SEQ ID NO: 29473 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
tttgtaagtcaagtaaattg

SEQ ID NO: 29474 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
aaatggtgtttccatgtatt

SEQ ID NO: 29475 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
tgctgactgattatgcaaaa

SEQ ID NO: 29476 - DNA, 20 bp, Artificial Sequence
  Description of Artificial Sequence: Synthetic oligonucleotide
  Target: ATXN1; (-) strand; PAM type: NNNNGHTT; PAM sequence: GACTGATT
aacaaaaagagttttttgct

SEQ ID NO: 29477 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
ctgagaattttgaaaacaaa

SEQ ID NO: 29478 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
ttatgagagcgtctacttaa

SEQ ID NO: 29479 - DNA, 20 bp, Artificial Sequence
  Description of Artificial Sequence: Synthetic oligonucleotide
  Target: ATXN1; (-) strand; PAM type: NNNNGHTT; PAM sequence: GGCAGTTT
taccagtttgtatttccaga

SEQ ID NO: 29480 - DNA, 20 bp, Artificial Sequence
  Description of Artificial Sequence: Synthetic oligonucleotide
  Target: ATXN1; (-) strand; PAM type: NNNNGHTT; PAM sequence: ACCAGTTT
attactttcagtaaagtcat

SEQ ID NO: 29481 - DNA, 20 bp, Artificial Sequence
  Description of Artificial Sequence: Synthetic oligonucleotide
  Target: ATXN1; (-) strand; PAM type: NNNNGHTT; PAM sequence: TACGGCTT
atgtaagagttttcaagttt

SEQ ID NO: 29482 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
actggtaaatgtaagagttt

SEQ ID NO: 29483 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
agcagcatactggtaaatgt

SEQ ID NO: 29484 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
tccaccacacccagacattt

SEQ ID NO: 29485 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
cacctcagcctcccaaagtg

SEQ ID NO: 29486 - DNA, 20 bp, Artificial Sequence
  Description of Artificial Sequence: Synthetic oligonucleotide
  Target: ATXN1; (-) strand; PAM type: NNNNGHTT; PAM sequence: TGAGGTTT
tttttttttttatatagtga

SEQ ID NO: 29487 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
gtggcatgattttggctcat

SEQ ID NO: 29488 - DNA, 20 bp, Artificial Sequence
  Description of Artificial Sequence: Synthetic oligonucleotide
  Target: ATXN1; (-) strand; PAM type: NNNNGHTT; PAM sequence: GCATGATT
acccaggctggagtgcagtg

SEQ ID NO: 29489 - DNA, 20 bp, Artificial Sequence
  Description of Artificial Sequence: Synthetic oligonucleotide
  Target: ATXN1; (-) strand; PAM type: NNNNGHTT; PAM sequence: AGCCGTTT
tcccttctaactggacagtt

SEQ ID NO: 29490 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
tttttctaccgtatagttat

SEQ ID NO: 29491 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
agtagagattgtagaagtag

SEQ ID NO: 29492 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
agacaaacatcaaatggtag

SEQ ID NO: 29493 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
tctgaaggcatttataaatt

SEQ ID NO: 29494 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
ctcttttataaaaatggaac

SEQ ID NO: 29495 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
tggtacaggtaaacatctcc

SEQ ID NO: 29496 - DNA, 20 bp, Artificial Sequence
  Description of Artificial Sequence: Synthetic oligonucleotide
  Target: ATXN1; (-) strand; PAM type: NNNNGHTT; PAM sequence: GATAGCTT
aagatctgctgcaaggaact

SEQ ID NO: 29497 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
acaggtctaggcgttttaca

SEQ ID NO: 29498 - DNA, 20 bp, Artificial Sequence
  Description of Artificial Sequence: Synthetic oligonucleotide
  Target: ATXN1; (-) strand; PAM type: NNNNGHTT; PAM sequence: AGGCGTTT
gtttttataattacaggtct

SEQ ID NO: 29499 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
gcagcctaactcagtgagaa

SEQ ID NO: 29500 - DNA, 20 bp, Artificial Sequence
  Description of Artificial Sequence: Synthetic oligonucleotide
  Target: ATXN1; (-) strand; PAM type: NNNNGHTT; PAM sequence: TCCCGTTT
agattatgcaatatgatgtt

SEQ ID NO: 29501 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
gtgtgagagattatgcaata

SEQ ID NO: 29502 - DNA, 20 bp, Artificial Sequence
  Description of Artificial Sequence: Synthetic oligonucleotide
  Target: ATXN1; (-) strand; PAM type: NNNNGHTT; PAM sequence: GAGAGATT
gcgtgtgtgcatgtgtgtgt

SEQ ID NO: 29503 - DNA, 20 bp, Artificial Sequence
  Description of Artificial Sequence: Synthetic oligonucleotide
  Target: ATXN1; (-) strand; PAM type: NNNNGHTT; PAM sequence: GCATGCTT
gtgtgtgtgtgtgtgtgtgc

SEQ ID NO: 29504 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
tgcctgctgagtttttgaca

SEQ ID NO: 29505 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
acctgctgtgtctctgcctg

SEQ ID NO: 29506 - DNA, 20 bp, Artificial Sequence
  Description of Artificial Sequence: Synthetic oligonucleotide
  Target: ATXN1; (-) strand; PAM type: NNNNGHTT; PAM sequence: ACGGGATT
gcagggaaggaggggcagga

SEQ ID NO: 29507 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
gacattttctatgaagaact

SEQ ID NO: 29508 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
aaagagagcatcaaattcag

SEQ ID NO: 29509 - DNA, 20 bp, Artificial Sequence
  Description of Artificial Sequence: Synthetic oligonucleotide
  Target: ATXN1; (-) strand; PAM type: NNNNGHTT; PAM sequence: TGTAGTTT
gttattaacaaagaggcatg

SEQ ID NO: 29510 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
cacatggcccagaacatagt

SEQ ID NO: 29511 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
tgtcaataatgcagaggtaa

SEQ ID NO: 29512 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
atccgttggctgtatttact

SEQ ID NO: 29513 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
tgtgaactgttggcttaagt

SEQ ID NO: 29514 - DNA, 20 bp, Artificial Sequence
  Description of Artificial Sequence: Synthetic oligonucleotide
  Target: ATXN1; (-) strand; PAM type: NNNNGHTT; PAM sequence: GTTGGCTT
aagcatgacctctgtgaact

SEQ ID NO: 29515 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
gccaccatgccccagccccg

SEQ ID NO: 29516 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cacctcagcctcccaaagtg

SEQ ID NO: 29517 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcttcctgagtag

SEQ ID NO: 29518 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
ggttcaagtgattctcctgc

SEQ ID NO: 29519 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
caaactctgccttccggttc

SEQ ID NO: 29520 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
tttttttttttgagacagag

SEQ ID NO: 29521 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
ctctgggaaaaatgaggtga

SEQ ID NO: 29522 - DNA, 20 bp, Artificial Sequence
  Description of Artificial Sequence: Synthetic oligonucleotide
  Target: ATXN1; (-) strand; PAM type: NNNNGHTT; PAM sequence: TTGAGCTT
tatgaacatgtcggtttcac

SEQ ID NO: 29523 - DNA, 20 bp, Artificial Sequence
  Description of Artificial Sequence: Synthetic oligonucleotide
  Target: ATXN1; (-) strand; PAM type: NNNNGHTT; PAM sequence: GTCGGTTT
ctcagttgaaatatgaacat

SEQ ID NO: 29524 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
tagtgttttggcatctggat

SEQ ID NO: 29525 - DNA, 20 bp, Artificial Sequence
  Description of Artificial Sequence: Synthetic oligonucleotide
  Target: ATXN1; (-) strand; PAM type: NNNNGHTT; PAM sequence: TCTGGATT
ttctgcttagtgttttggca

SEQ ID NO: 29526 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
gtggattttaggtttctgct

SEQ ID NO: 29527 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
gcaggacgtggattttaggt

SEQ ID NO: 29528 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
gcttaggcaggacgtggatt

SEQ ID NO: 29529 - DNA, 20 bp, Artificial Sequence
  Description of Artificial Sequence: Synthetic oligonucleotide
  Target: ATXN1; (-) strand; PAM type: NNNNGHTT; PAM sequence: CGTGGATT
atttagccgcttaggcagga

SEQ ID NO: 29530 - DNA, 20 bp, Artificial Sequence
  Description of Artificial Sequence: Synthetic oligonucleotide
  Target: ATXN1; (-) strand; PAM type: NNNNGHTT; PAM sequence: AGCCGCTT
acttgtttctaatgaaattt

SEQ ID NO: 29531 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
ccttttgatgttatcatctg

SEQ ID NO: 29532 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
tagactttgtgaacaggtaa

SEQ ID NO: 29533 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
ctcatatccattttgtgttg

SEQ ID NO: 29534 - DNA, 20 bp, Artificial Sequence
  Description of Artificial Sequence: Synthetic oligonucleotide
  Target: ATXN1; (-) strand; PAM type: NNNNGHTT; PAM sequence: TGTTGATT
gtgggacccatacataattt

SEQ ID NO: 29535 - DNA, 20 bp, Artificial Sequence
  Description of Artificial Sequence: Synthetic oligonucleotide
  Target: ATXN1; (-) strand; PAM type: NNNNGHTT; PAM sequence: GCTGGATT
ccgccttggccccccaaagt

SEQ ID NO: 29536 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
gtttttttttttagtataga

SEQ ID NO: 29537 - DNA, 20 bp, Artificial Sequence
  Description of Artificial Sequence: Synthetic oligonucleotide
  Target: ATXN1; (-) strand; PAM type: NNNNGHTT; PAM sequence: GCTAGTTT
ggcgcccaccaccatgcctg

SEQ ID NO: 29538 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccgggtca

SEQ ID NO: 29539 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctctgcctcccaggttc

SEQ ID NO: 29540 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
ctgtagtgcaatggcacgat

SEQ ID NO: 29541 - DNA, 20 bp, Artificial Sequence
  Description of Artificial Sequence: Synthetic oligonucleotide
  Target: ATXN1; (-) strand; PAM type: NNNNGHTT; PAM sequence: CTTAGATT
gtgaggcagaatctattctg

SEQ ID NO: 29542 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
cgtaggtgaggcagaatcta

SEQ ID NO: 29543 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
gagaatgcaggttttggggg

SEQ ID NO: 29544 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
agtgcaagttggaagagaat

SEQ ID NO: 29545 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
gcaaggaggaagtcatgtgc

SEQ ID NO: 29546 - DNA, 20 bp, Artificial Sequence
  Description of Artificial Sequence: Synthetic oligonucleotide
  Target: ATXN1; (-) strand; PAM type: NNNNGHTT; PAM sequence: GGGTGATT
ggtcatttgatagaaggggt

SEQ ID NO: 29547 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
agttctccctttctggagtt

SEQ ID NO: 29548 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
tggacacagttctccctttc

SEQ ID NO: 29549 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
tattgagtgcccataatgtg

SEQ ID NO: 29550 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
tttggctcatttattcactc

SEQ ID NO: 29551 - DNA, 20 bp, Artificial Sequence
  Description of Artificial Sequence: Synthetic oligonucleotide
  Target: ATXN1; (-) strand; PAM type: NNNNGHTT; PAM sequence: GTATGATT
aatcaacactaattaaatca

SEQ ID NO: 29552 - DNA, 20 bp, Artificial Sequence
  Description of Artificial Sequence: Synthetic oligonucleotide
  Target: ATXN1; (-) strand; PAM type: NNNNGHTT; PAM sequence: AAACGATT
gtcatactctgtgtgctgga

SEQ ID NO: 29553 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
ccctgagacttgaagactga

SEQ ID NO: 29554 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
ccacttcccagaaggtgtca

SEQ ID NO: 29555 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
caagtacaggaaaatatgat

SEQ ID NO: 29556 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
atgtatatataatatataaa

SEQ ID NO: 29557 - DNA, 20 bp, Artificial Sequence
  Description of Artificial Sequence: Synthetic oligonucleotide
  Target: ATXN1; (-) strand; PAM type: NNNNGHTT; PAM sequence: GCCCGTTT
ctgtgaggtaggtgttatta

SEQ ID NO: 29558 - DNA, 20 bp, Artificial Sequence
  Description of Artificial Sequence: Synthetic oligonucleotide
  Target: ATXN1; (-) strand; PAM type: NNNNGHTT; PAM sequence: TGTAGCTT
tgtgctaaacattttactta

SEQ ID NO: 29559 - DNA, 20 bp, Artificial Sequence
  Description of Artificial Sequence: Synthetic oligonucleotide
  Target: ATXN1; (-) strand; PAM type: NNNNGHTT; PAM sequence: GAGTGCTT
ctgtacaattaatatttatg

SEQ ID NO: 29560 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
ttttacccataagttgtaaa

SEQ ID NO: 29561 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
acacagatgctaatgctaat

SEQ ID NO: 29562 - DNA, 20 bp, Artificial Sequence
  Description of Artificial Sequence: Synthetic oligonucleotide
  Target: ATXN1; (-) strand; PAM type: NNNNGHTT; PAM sequence: CACAGATT
tgcttccttcacacatatat

SEQ ID NO: 29563 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
gaaatgctttgttgttgatg

SEQ ID NO: 29564 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
gtacagaaatgctttgttgt

SEQ ID NO: 29565 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
catagataatttttgtacag

SEQ ID NO: 29566 - DNA, 20 bp, Artificial Sequence
  Description of Artificial Sequence: Synthetic oligonucleotide
  Target: ATXN1; (-) strand; PAM type: NNNNGHTT; PAM sequence: TGTAGTTT
agcacttgaatggcgatatg

SEQ ID NO: 29567 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
tatttataattacgtcagct

SEQ ID NO: 29568 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
attttttttttagcaaaaga

SEQ ID NO: 29569 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
tctaatagaccacatatgaa

SEQ ID NO: 29570 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
aaatagtcttgcctgtattt

SEQ ID NO: 29571 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
aacatagggcagaattatga

SEQ ID NO: 29572 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
aagcaacatagggcagaatt

SEQ ID NO: 29573 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
atcagaaaaatgatttgctt

SEQ ID NO: 29574 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
aagcctcaatcagaaaaatg

SEQ ID NO: 29575 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
aggaaaagcctcaatcagaa

SEQ ID NO: 29576 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
cctgggcaacaggagtgaaa

SEQ ID NO: 29577 - DNA, 20 bp, Artificial Sequence
  Description of Artificial Sequence: Synthetic oligonucleotide
  Target: ATXN1; (-) strand; PAM type: NNNNGHTT; PAM sequence: TGGAGATT
aaggcggaggttatggtgag

SEQ ID NO: 29578 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
tcaggaggctgaggcaggat

SEQ ID NO: 29579 - DNA, 20 bp, Artificial Sequence
  Description of Artificial Sequence: Synthetic oligonucleotide
  Target: ATXN1; (-) strand; PAM type: NNNNGHTT; PAM sequence: AGTAGTTT
tgggaagattgctggagacc

SEQ ID NO: 29580 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
ttctttgggaggcctaggtg

SEQ ID NO: 29581 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
gaattataattcaatttaaa

SEQ ID NO: 29582 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
aatgatcaaattaagacttt

SEQ ID NO: 29583 - DNA, 20 bp, Artificial Sequence
  Description of Artificial Sequence: Synthetic oligonucleotide
  Target: ATXN1; (-) strand; PAM type: NNNNGHTT; PAM sequence: CTAAGATT
aagaattttgccttatatta

SEQ ID NO: 29584 - DNA, 20 bp, Artificial Sequence
  Description of Artificial Sequence: Synthetic oligonucleotide
  Target: ATXN1; (-) strand; PAM type: NNNNGHTT; PAM sequence: CCCTGATT
gcttgaatgaatgaggacat

SEQ ID NO: 29585 - DNA, 20 bp, Artificial Sequence
  Description of Artificial Sequence: Synthetic oligonucleotide
  Target: ATXN1; (-) strand; PAM type: NNNNGHTT; PAM sequence: CAATGCTT
gctgaatcttaaaggaagag

SEQ ID NO: 29586 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
atattctgtgcaaagaattg

SEQ ID NO: 29587 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
tattcacccacacatcaaac

SEQ ID NO: 29588 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
tcactaaaaaatggattttt

SEQ ID NO: 29589 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
agagtttcatttcactaaaa

SEQ ID NO: 29590 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
catctggaagtgaaaacgct

SEQ ID NO: 29591 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
gcagcatgactattttttaa

SEQ ID NO: 29592 - DNA, 20 bp, Artificial Sequence
  Description of Artificial Sequence: Synthetic oligonucleotide
  Target: ATXN1; (-) strand; PAM type: NNNNGHTT; PAM sequence: TCCGGATT
gtggggaggttgagtcttac

SEQ ID NO: 29593 - DNA, 20 bp, Artificial Sequence
  Description of Artificial Sequence: Synthetic oligonucleotide
  Target: ATXN1; (-) strand; PAM type: NNNNGHTT; PAM sequence: CGTCGCTT
ggcagagctctcccgggagt

SEQ ID NO: 29594 - DNA, 20 bp, Artificial Sequence
  Description of Artificial Sequence: Synthetic oligonucleotide
  Target: ATXN1; (-) strand; PAM type: NNNNGHTT; PAM sequence: CTCGGATT
agtactgaaattctctgctg

SEQ ID NO: 29595 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
gtaagttgggactgatgttc

SEQ ID NO: 29596 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
gaaaagaaaatccatcaagt

SEQ ID NO: 29597 - DNA, 20 bp, Artificial Sequence
  Description of Artificial Sequence: Synthetic oligonucleotide
  Target: ATXN1; (-) strand; PAM type: NNNNGHTT; PAM sequence: TAGTGCTT
agacgtgggtgctttctgta

SEQ ID NO: 29598 - DNA, 20 bp, Artificial Sequence
  Description of Artificial Sequence: Synthetic oligonucleotide
  Target: ATXN1; (-) strand; PAM type: NNNNGHTT; PAM sequence: GGGTGCTT
cagaatcagctaggagacgt

SEQ ID NO: 29599 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
tcagattcttttccagctgt

SEQ ID NO: 29600 - DNA, 20 bp, Artificial Sequence
  Description of Artificial Sequence: Synthetic oligonucleotide
  Target: ATXN1; (-) strand; PAM type: NNNNGHTT; PAM sequence: CTCAGATT
ccagccaccagtgcaacctg

SEQ ID NO: 29601 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
ctaaaagtaaccaatcatgg

SEQ ID NO: 29602 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
gtcagtgctctgtagctagc

SEQ ID NO: 29603 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
tcagtgctctgtagctagca

SEQ ID NO: 29604 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
agtgtcgctccttgagtggt

SEQ ID NO: 29605 - DNA, 20 bp, Artificial Sequence
  Description of Artificial Sequence: Synthetic oligonucleotide
  Target: ATXN1; (-) strand; PAM type: NNNNGHTT; PAM sequence: GTCTGCTT
cacacaggagtaattagaag

SEQ ID NO: 29606 - DNA, 20 bp, Artificial Sequence
  Description of Artificial Sequence: Synthetic oligonucleotide
  Target: ATXN1; (-) strand; PAM type: NNNNGHTT; PAM sequence: GGGGGCTT
ctttccatagtccccaggga

SEQ ID NO: 29607 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
gatagcatgtcagaattatg

SEQ ID NO: 29608 - DNA, 20 bp, Artificial Sequence
  Description of Artificial Sequence: Synthetic oligonucleotide
  Target: ATXN1; (-) strand; PAM type: NNNNGHTT; PAM sequence: TATGGCTT
aagtgatagcatgtcagaat

SEQ ID NO: 29609 - DNA, 20 bp, Artificial Sequence
  Description of Artificial Sequence: Synthetic oligonucleotide
  Target: ATXN1; (-) strand; PAM type: NNNNGHTT; PAM sequence: TTATGCTT
tatgcctgttcattttattc

SEQ ID NO: 29610 - DNA, 20 bp, Artificial Sequence
  Description of Artificial Sequence: Synthetic oligonucleotide
  Target: ATXN1; (-) strand; PAM type: NNNNGHTT; PAM sequence: GATGGCTT
ccctggagagaaggcaggag

SEQ ID NO: 29611 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
tatacagtatgatagtatta

SEQ ID NO: 29612 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
atacatacatatatataatt

SEQ ID NO: 29613 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
ataattggactaatatatgt

SEQ ID NO: 29614 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
ataatttgactaatatgtat

SEQ ID NO: 29615 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
tattaattagactaatatat

SEQ ID NO: 29616 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
attgttcctaatggacacag

SEQ ID NO: 29617 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
ttgggaaagcaatttggcac

SEQ ID NO: 29618 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
tcttgattctgaaatgattt

SEQ ID NO: 29619 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
agatctctttcttgattctg

SEQ ID NO: 29620 - DNA, 20 bp, Artificial Sequence
  Description of Artificial Sequence: Synthetic oligonucleotide
  Target: ATXN1; (-) strand; PAM type: NNNNGHTT; PAM sequence: TCTTGATT
tcagcacaaatagatctctt

SEQ ID NO: 29621 - DNA, 20 bp, Artificial Sequence
  Description of Artificial Sequence: Synthetic oligonucleotide
  Target: ATXN1; (-) strand; PAM type: NNNNGHTT; PAM sequence: GGATGCTT
caatgtgagagacagggaca

SEQ ID NO: 29622 - DNA, 20 bp, Artificial Sequence
  Description of Artificial Sequence: Synthetic oligonucleotide
  Target: ATXN1; (-) strand; PAM type: NNNNGHTT; PAM sequence: TTATGCTT
tacgaagtaactctcgtttg

SEQ ID NO: 29623 - DNA, 20 bp, Artificial Sequence
  Description of Artificial Sequence: Synthetic oligonucleotide
  Target: ATXN1; (-) strand; PAM type: NNNNGHTT; PAM sequence: TCTCGTTT
ccgtcatcttacgaagtaac

SEQ ID NO: 29624 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
atctaagtcattagttaatg

SEQ ID NO: 29625 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
ttggacacttttggtatcca

SEQ ID NO: 29626 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
atgatttcctgttctaagtg

SEQ ID NO: 29627 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
cttgaggtacttatatttgt

SEQ ID NO: 29628 - DNA, 20 bp, Artificial Sequence
  Description of Artificial Sequence: Synthetic oligonucleotide
  Target: ATXN1; (-) strand; PAM type: NNNNGHTT; PAM sequence: ACAAGCTT
taaagaagtctctcaatttc

SEQ ID NO: 29629 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
atctaatcagccctctcttc

SEQ ID NO: 29630 - DNA, 20 bp, Artificial Sequence
  Description of Artificial Sequence: Synthetic oligonucleotide
  Target: ATXN1; (-) strand; PAM type: NNNNGHTT; PAM sequence: TTTCGATT
caaaatctaattacaaagtt

SEQ ID NO: 29631 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
agtctggcaaaatctaatta

SEQ ID NO: 29632 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
tcaccctttgagccaggacc

SEQ ID NO: 29633 - DNA, 20 bp, Artificial Sequence
  Description of Artificial Sequence: Synthetic oligonucleotide
  Target: ATXN1; (-) strand; PAM type: NNNNGHTT; PAM sequence: GGCCGATT
taggaggatgatgaagaacg

SEQ ID NO: 29634 - DNA, 20 bp, Artificial Sequence
  Description of Artificial Sequence: Synthetic oligonucleotide
  Target: ATXN1; (-) strand; PAM type: NNNNGHTT; PAM sequence: GTCCGTTT
tttgaacagtaccacattct

SEQ ID NO: 29635 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
attaacttcagcgtcagctg

SEQ ID NO: 29636 - DNA, 20 bp, Artificial Sequence
  Description of Artificial Sequence: Synthetic oligonucleotide
  Target: ATXN1; (-) strand; PAM type: NNNNGHTT; PAM sequence: TCCAGATT
agaaggtaaattagttcccc

SEQ ID NO: 29637 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
atggagaaagaacacactga

SEQ ID NO: 29638 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
tgcctgcctttcagccattt

SEQ ID NO: 29639 - DNA, 20 bp, Artificial Sequence
  Description of Artificial Sequence: Synthetic oligonucleotide
  Target: ATXN1; (-) strand; PAM type: NNNNGHTT; PAM sequence: TTCCGTTT
ttgtttactctctgtcaaca

SEQ ID NO: 29640 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
aggcattaatagcatatgtt

SEQ ID NO: 29641 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
taacaggcattaatagcata

SEQ ID NO: 29642 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
aaaacgagaaggcaccacca

SEQ ID NO: 29643 - DNA, 20 bp, Artificial Sequence
  Description of Artificial Sequence: Synthetic oligonucleotide
  Target: ATXN1; (-) strand; PAM type: NNNNGHTT; PAM sequence: ACTAGCTT
gcctggctgggttccagctc

SEQ ID NO: 29644 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
gaagaaggaaagtctctcgc

SEQ ID NO: 29645 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
aaacaaaataacggggctgc

SEQ ID NO: 29646 - DNA, 20 bp, Artificial Sequence
  Description of Artificial Sequence: Synthetic oligonucleotide
  Target: ATXN1; (-) strand; PAM type: NNNNGHTT; PAM sequence: GCTAGATT
tgcacagcctgggtgacaga

SEQ ID NO: 29647 - DNA, 20 bp, Artificial Sequence
  Description of Artificial Sequence: Synthetic oligonucleotide
  Target: ATXN1; (-) strand; PAM type: NNNNGHTT; PAM sequence: GATTGCTT
tctggaggctgaggcaggag

SEQ ID NO: 29648 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
ctcctctggaggctgaggca

SEQ ID NO: 29649 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
cttgaggccaggagttcaag

SEQ ID NO: 29650 - DNA, 20 bp, Artificial Sequence
  Description of Artificial Sequence: Synthetic oligonucleotide
  Target: ATXN1; (-) strand; PAM type: NNNNGHTT; PAM sequence: GATTGCTT
ttgggaggccaagatgagag

SEQ ID NO: 29651 - DNA, 20 bp, Artificial Sequence
  Description of Artificial Sequence: Synthetic oligonucleotide
  Target: ATXN1; (-) strand; PAM type: NNNNGHTT; PAM sequence: AGAGGATT
cactttgggaggccaagatg

SEQ ID NO: 29652 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
aaatcagctcactttgttta

SEQ ID NO: 29653 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
tagatatgcaaatcagctca

SEQ ID NO: 29654 - DNA, 20 bp, Artificial Sequence
  Description of Artificial Sequence: Synthetic oligonucleotide
  Target: ATXN1; (-) strand; PAM type: NNNNGHTT; PAM sequence: ACCCGATT
catatttgcaggcatccagc

SEQ ID NO: 29655 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
gatgattttaatgtttttgc

SEQ ID NO: 29656 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
tccttcaaatgtgatgattt

SEQ ID NO: 29657 - DNA, 20 bp, Artificial Sequence
  Description of Artificial Sequence: Synthetic oligonucleotide
  Target: ATXN1; (-) strand; PAM type: NNNNGHTT; PAM sequence: TGATGATT
acaaagggctccttcaaatg

SEQ ID NO: 29658 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
tttgtagttgtggagaatgg

SEQ ID NO: 29659 - DNA, 20 bp, Artificial Sequence
  Description of Artificial Sequence: Synthetic oligonucleotide
  Target: ATXN1; (-) strand; PAM type: NNNNGHTT; PAM sequence: CAAAGATT
atccaaagtcatttttaaat

SEQ ID NO: 29660 - DNA, 20 bp, Artificial Sequence
  Description of Artificial Sequence: Synthetic oligonucleotide
  Target: ATXN1; (-) strand; PAM type: NNNNGHTT; PAM sequence: AGTGGATT
atgaggtgctttgggtggga

SEQ ID NO: 29661 - DNA, 20 bp, Artificial Sequence
  Description of Artificial Sequence: Synthetic oligonucleotide
  Target: ATXN1; (-) strand; PAM type: NNNNGHTT; PAM sequence: AGGTGCTT
tatttgatgcagcctccatg

SEQ ID NO: 29662 - DNA, 20 bp, Artificial Sequence
  Description of Artificial Sequence: Synthetic oligonucleotide
  Target: ATXN1; (-) strand; PAM type: NNNNGHTT; PAM sequence: TGAAGATT
gtggaaggcatagcccttga

SEQ ID NO: 29663 - DNA, 20 bp, Artificial Sequence
  Description of Artificial Sequence: Synthetic oligonucleotide
  Target: ATXN1; (-) strand; PAM type: NNNNGHTT; PAM sequence: CTGAGCTT
gcaagatcttatagtaaatg

SEQ ID NO: 29664 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
attcgtgggtgtgtgcttca

SEQ ID NO: 29665 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
tgaaattcgtgggtgtgtgc

SEQ ID NO: 29666 - DNA, 20 bp, Artificial Sequence
  Description of Artificial Sequence: Synthetic oligonucleotide
  Target: ATXN1; (-) strand; PAM type: NNNNGHTT; PAM sequence: GTGTGCTT
ctgagatgaaattcgtgggt

SEQ ID NO: 29667 - DNA, 20 bp, Artificial Sequence
  Description of Artificial Sequence: Synthetic oligonucleotide
  Target: ATXN1; (-) strand; PAM type: NNNNGHTT; PAM sequence: CCATGCTT
tataacctctaatttgctca

SEQ ID NO: 29668 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
aattctcctccttccaccgg

SEQ ID NO: 29669 - DNA, 20 bp, Artificial Sequence
  Description of Artificial Sequence: Synthetic oligonucleotide
  Target: ATXN1; (-) strand; PAM type: NNNNGHTT; PAM sequence: CGGAGATT
tgtacctatgtcttataccc

SEQ ID NO: 29670 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
aaaaaaaaaaaatagattta

SEQ ID NO: 29671 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
tgtctcaaaaaaaaaaaaaa

SEQ ID NO: 29672 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
gaggtagaggctgcagtgag

SEQ ID NO: 29673 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
cgggtggatcacctgaggtc

SEQ ID NO: 29674 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
atgtttctccttacatcaag

SEQ ID NO: 29675 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
actgcctttagcatttagga

SEQ ID NO: 29676 - DNA, 20 bp, Artificial Sequence
  Description of Artificial Sequence: Synthetic oligonucleotide
  Target: ATXN1; (-) strand; PAM type: NNNNGHTT; PAM sequence: CATGGATT
ctttagcctatgctgggagc

SEQ ID NO: 29677 - DNA, 20 bp, Artificial Sequence
  Description of Artificial Sequence: Synthetic oligonucleotide
  Target: ATXN1; (-) strand; PAM type: NNNNGHTT; PAM sequence: GTTGGCTT
ttttttttaaatcctagact

SEQ ID NO: 29678 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
acttcattcttaatggcaga

SEQ ID NO: 29679 - DNA, 20 bp, Artificial Sequence
  Description of Artificial Sequence: Synthetic oligonucleotide
  Target: ATXN1; (-) strand; PAM type: NNNNGHTT; PAM sequence: ACCAGTTT
gttaatatattcatcacctc

SEQ ID NO: 29680 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
tttataatgcatacattata

SEQ ID NO: 29681 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
tatatttatggggtacagtg

SEQ ID NO: 29682 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
caccatttatttctttaatt

SEQ ID NO: 29683 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
aaggaaataactcttaatta

SEQ ID NO: 29684 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
aagttaggatcaatactcgg

SEQ ID NO: 29685 - DNA, 20 bp, Artificial Sequence
  Description of Artificial Sequence: Synthetic oligonucleotide
  Target: ATXN1; (-) strand; PAM type: NNNNGHTT; PAM sequence: CTCGGCTT
tggtaaagttaggatcaata

SEQ ID NO: 29686 - DNA, 20 bp, Artificial Sequence
  Description of Artificial Sequence: Synthetic oligonucleotide
  Target: ATXN1; (-) strand; PAM type: NNNNGHTT; PAM sequence: CGTAGTTT
tgtgggtgtggtctgggccg

SEQ ID NO: 29687 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
ttttctcctgccacccccac

SEQ ID NO: 29688 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
ggtgtgactttttgacggag

SEQ ID NO: 29689 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
gtgacaccattgggtgtcag

SEQ ID NO: 29690 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
aaagtcttctcagtgcacaa

SEQ ID NO: 29691 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
atgatagaaggaaatctttg

SEQ ID NO: 29692 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
agccaccatgcccggcctaa

SEQ ID NO: 29693 - DNA, 20 bp, Artificial Sequence
  Description of Artificial Sequence: Synthetic oligonucleotide
  Target: ATXN1; (-) strand; PAM type: NNNNGHTT; PAM sequence: CTAAGCTT
tgtgagccaccatgcccggc

SEQ ID NO: 29694 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgcctcagcctcccaaaatg

SEQ ID NO: 29695 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
ggtttcagcatgttggccag

SEQ ID NO: 29696 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
ttttgtatttttagtagaga

SEQ ID NO: 29697 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgtctcaccctcctgagtag

SEQ ID NO: 29698 - DNA, 20 bp, Artificial Sequence
  Description of Artificial Sequence: Synthetic oligonucleotide
  Target: ATXN1; (-) strand; PAM type: NNNNGHTT; PAM sequence: CGGAGTTT
ctttttttttttttttgaga

SEQ ID NO: 29699 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
cttgttcccattcattcaag

SEQ ID NO: 29700 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
cctttaggtgtgatagctgt

SEQ ID NO: 29701 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
gggctgatgtcttgacatgt

SEQ ID NO: 29702 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
acactacagcagtgaacact

SEQ ID NO: 29703 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
agatttccatgtaggacaca

SEQ ID NO: 29704 - DNA, 20 bp, Artificial Sequence
  Description of Artificial Sequence: Synthetic oligonucleotide
  Target: ATXN1; (-) strand; PAM type: NNNNGHTT; PAM sequence: GTGAGATT
aaagacgcaatgaaccacat

SEQ ID NO: 29705 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
tacatatacaatggatgacc

SEQ ID NO: 29706 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
atgcttttattggtttgtgg

SEQ ID NO: 29707 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
ggatgatgcttttattggtt

SEQ ID NO: 29708 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
aagcaccggatgatgctttt

SEQ ID NO: 29709 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
tggctttgagaagcaccgga

SEQ ID NO: 29710 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
gttgctccaaaatcatttcc

SEQ ID NO: 29711 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
attagcattgaacattcagt

SEQ ID NO: 29712 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
ctgctcttaagaggagatga

SEQ ID NO: 29713 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
agaataatcctttcctttgt

SEQ ID NO: 29714 - DNA, 20 bp, Artificial Sequence
  Description of Artificial Sequence: Synthetic oligonucleotide
  Target: ATXN1; (-) strand; PAM type: NNNNGHTT; PAM sequence: GGCAGCTT
ctatacagacataaaatagt

SEQ ID NO: 29715 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
tgttgttgaatgggtagtga

SEQ ID NO: 29716 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
aaacttgtaaagtattttga

SEQ ID NO: 29717 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
ctgcctaattcataacttat

SEQ ID NO: 29718 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
taaatgattcaatcatttgg

SEQ ID NO: 29719 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
ataccttaccccagcgaggt

SEQ ID NO: 29720 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
cttgagtttctagttctggc

SEQ ID NO: 29721 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
gaattacttgagtttctagt

SEQ ID NO: 29722 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
ctaagaatcaaaggaattac

SEQ ID NO: 29723 - DNA, 20 bp, Artificial Sequence
  Description of Artificial Sequence: Synthetic oligonucleotide
  Target: ATXN1; (-) strand; PAM type: NNNNGHTT; PAM sequence: CTTCGTTT
tagtaggtgatggtggggtc

SEQ ID NO: 29724 - DNA, 20 bp, Artificial Sequence
  Description of Artificial Sequence: Synthetic oligonucleotide
  Target: ATXN1; (-) strand; PAM type: NNNNGHTT; PAM sequence: CATAGCTT
taccagctaggtacccatca

SEQ ID NO: 29725 - DNA, 20 bp, Artificial Sequence
  Description of Artificial Sequence: Synthetic oligonucleotide
  Target: ATXN1; (-) strand; PAM type: NNNNGHTT; PAM sequence: ACGTGCTT
tttaacactgccacgttggg

SEQ ID NO: 29726 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
taagaatttcatttttcagt

SEQ ID NO: 29727 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
cttaaataagaatttcattt

SEQ ID NO: 29728 - DNA, 20 bp, Artificial Sequence
  Description of Artificial Sequence: Synthetic oligonucleotide
  Target: ATXN1; (-) strand; PAM type: NNNNGHTT; PAM sequence: CTCAGATT
ttttaagtggctggctggct

SEQ ID NO: 29729 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
cactgcgcacagctgaaata

SEQ ID NO: 29730 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgcctcggcctcactaagtg

SEQ ID NO: 29731 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
tttgtattttttagtagaga

SEQ ID NO: 29732 - DNA, 20 bp, Artificial Sequence
  Description of Artificial Sequence: Synthetic oligonucleotide
  Target: ATXN1; (-) strand; PAM type: NNNNGHTT; PAM sequence: AATTGATT
tactctggattgttgaaaca

SEQ ID NO: 29733 - DNA, 20 bp, Artificial Sequence
  Description of Artificial Sequence: Synthetic oligonucleotide
  Target: ATXN1; (-) strand; PAM type: NNNNGHTT; PAM sequence: TCTGGATT
tcttctacttgtatttctac

SEQ ID NO: 29734 - DNA, 20 bp, Artificial Sequence
  Description of Artificial Sequence: Synthetic oligonucleotide
  Target: ATXN1; (-) strand; PAM type: NNNNGHTT; PAM sequence: ATACGCTT
atagattacgcttgcacaaa

SEQ ID NO: 29735 - DNA, 20 bp, Artificial Sequence
  Description of Artificial Sequence: Synthetic oligonucleotide
  Target: ATXN1; (-) strand; PAM type: NNNNGHTT; PAM sequence: TTACGCTT
ttttctgcttgcaaaataga

SEQ ID NO: 29736 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
tgagaattttctgcttgcaa

SEQ ID NO: 29737 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
ctctaaaatacgtgagaatt

SEQ ID NO: 29738 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
gattctgaaaactttaagat

SEQ ID NO: 29739 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
tggcatggattctgaaaact

SEQ ID NO: 29740 - DNA, 20 bp, Artificial Sequence
  Description of Artificial Sequence: Synthetic oligonucleotide
  Target: ATXN1; (-) strand; PAM type: NNNNGHTT; PAM sequence: CATGGATT
aattttcttaagtcccttgg

SEQ ID NO: 29741 - DNA, 20 bp, Artificial Sequence
  Description of Artificial Sequence: Synthetic oligonucleotide
  Target: ATXN1; (-) strand; PAM type: NNNNGHTT; PAM sequence: GACAGCTT
ctgatgcttagtatacaaaa

SEQ ID NO: 29742 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
gttgggggcagatgctttgc

SEQ ID NO: 29743 - DNA, 20 bp, Artificial Sequence
  Description of Artificial Sequence: Synthetic oligonucleotide
  Target: ATXN1; (-) strand; PAM type: NNNNGHTT; PAM sequence: AGATGCTT
gtaaaatagctgttgggggc

SEQ ID NO: 29744 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
tatgattttgcggaagacaa

SEQ ID NO: 29745 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
acagatgaacttgaccttct

SEQ ID NO: 29746 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
gtattcatattgaaacactg

SEQ ID NO: 29747 - DNA, 20 bp, Artificial Sequence
  Description of Artificial Sequence: Synthetic oligonucleotide
  Target: ATXN1; (-) strand; PAM type: NNNNGHTT; PAM sequence: TATGGATT
aaaaattaaaagctttaaag

SEQ ID NO: 29748 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
attaaaagcttaaaaaaatt

SEQ ID NO: 29749 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
atgcttcaattaaaaaaatt

SEQ ID NO: 29750 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
gaatttaaaagaaagtaaag

SEQ ID NO: 29751 - DNA, 20 bp, Artificial Sequence
  Description of Artificial Sequence: Synthetic oligonucleotide
  Target: ATXN1; (-) strand; PAM type: NNNNGHTT; PAM sequence: ACTTGCTT
ttgggaggctgaggcaagag

SEQ ID NO: 29752 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
aagccttcataggaagcaaa

SEQ ID NO: 29753 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
tggtcacagtggaacatgaa

SEQ ID NO: 29754 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
ttacattatattatgataat

SEQ ID NO: 29755 - DNA, 20 bp, Artificial Sequence
  Description of Artificial Sequence: Synthetic oligonucleotide
  Target: ATXN1; (-) strand; PAM type: NNNNGHTT; PAM sequence: GGCTGCTT
tggctgggtcaatcccagtc

SEQ ID NO: 29756 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
ggagaggagggaggagtggg

SEQ ID NO: 29757 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
acctgcctttccttatggaa

SEQ ID NO: 29758 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
caaatgaggcctaagtcaag

SEQ ID NO: 29759 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
acttctgccagtgtttttgt

SEQ ID NO: 29760 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
ctgcctctctaaacttctgc

SEQ ID NO: 29761 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
ctgtaccccacagccaccag

SEQ ID NO: 29762 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
ggagacccttggtttgtgga

SEQ ID NO: 29763 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
agataaggagacccttggtt

SEQ ID NO: 29764 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
gaggacaagataaggagacc

SEQ ID NO: 29765 - DNA, 20 bp, Artificial Sequence
  Description of Artificial Sequence: Synthetic oligonucleotide
  Target: ATXN1; (-) strand; PAM type: NNNNGHTT; PAM sequence: CATCGTTT
aagcatttccatctgctttc

SEQ ID NO: 29766 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
ggttcttgagaagcatttcc

SEQ ID NO: 29767 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
ttttttttttttttttgaga

SEQ ID NO: 29768 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gcaccacgtgccacgataat

SEQ ID NO: 29769 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
attttctttatttcttttaa

SEQ ID NO: 29770 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
gaggctgaggctgcagtgag

SEQ ID NO: 29771 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
gtgggaggattgcttagggc

SEQ ID NO: 29772 - DNA, 20 bp, Artificial Sequence
  Description of Artificial Sequence: Synthetic oligonucleotide
  Target: ATXN1; (-) strand; PAM type: NNNNGHTT; PAM sequence: GATTGCTT
ttgtgaagccaaagtgggag

SEQ ID NO: 29773 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
cactttgtgaagccaaagtg

SEQ ID NO: 29774 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
ccaggtggtcagctgggtgc

SEQ ID NO: 29775 - DNA, 20 bp, Artificial Sequence
  Description of Artificial Sequence: Synthetic oligonucleotide
  Target: ATXN1; (-) strand; PAM type: NNNNGHTT; PAM sequence: TTCCGTTT
cccacatctaacagtcagac

SEQ ID NO: 29776 - DNA, 20 bp, Artificial Sequence
  Description of Artificial Sequence: Synthetic oligonucleotide
  Target: ATXN1; (-) strand; PAM type: NNNNGHTT; PAM sequence: ATCTGATT
cacatatataacatgaaaac

SEQ ID NO: 29777 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
tttgttttctaatgtctcta

SEQ ID NO: 29778 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
ttattgttcctcagtccttg

SEQ ID NO: 29779 - DNA, 20 bp, Artificial Sequence
  Description of Artificial Sequence: Synthetic oligonucleotide
  Target: ATXN1; (-) strand; PAM type: NNNNGHTT; PAM sequence: CCTTGATT
actttttattgttcctcagt

SEQ ID NO: 29780 - DNA, 20 bp, Artificial Sequence
  Description of Artificial Sequence: Synthetic oligonucleotide
  Target: ATXN1; (-) strand; PAM type: NNNNGHTT; PAM sequence: ACCTGTTT
cctcttcccccatgcatcat

SEQ ID NO: 29781 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
taagtatcatatgatccaaa

SEQ ID NO: 29782 - DNA, 20 bp, Artificial Sequence
  Description of Artificial Sequence: Synthetic oligonucleotide
  Target: ATXN1; (-) strand; PAM type: NNNNGHTT; PAM sequence: CACTGCTT
tttgaggctcatcctagggt

SEQ ID NO: 29783 - DNA, 20 bp, Artificial Sequence
  Description of Artificial Sequence: Synthetic oligonucleotide
  Target: ATXN1; (-) strand; PAM type: NNNNGHTT; PAM sequence: GTAAGCTT
tgttccagaccacatagcta

SEQ ID NO: 29784 - DNA, 20 bp, Artificial Sequence
  Description of Artificial Sequence: Synthetic oligonucleotide
  Target: ATXN1; (-) strand; PAM type: NNNNGHTT; PAM sequence: TATAGCTT
atatagacccggcaagtttc

SEQ ID NO: 29785 - DNA, 20 bp, Artificial Sequence
  Description of Artificial Sequence: Synthetic oligonucleotide
  Target: ATXN1; (-) strand; PAM type: NNNNGHTT; PAM sequence: GCAAGTTT
gttaagggaatatagacccg

SEQ ID NO: 29786 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
catctcagcctcccaaagtg

SEQ ID NO: 29787 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
atttgtaaagttagggtctc

SEQ ID NO: 29788 - DNA, 20 bp, Artificial Sequence
  Description of Artificial Sequence: Synthetic oligonucleotide
  Target: ATXN1; (-) strand; PAM type: NNNNGHTT; PAM sequence: GCGTGATT
ctccaggctggagtgcagtg

SEQ ID NO: 29789 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
aattgtcattctttttgttt

SEQ ID NO: 29790 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
agttaattgtcattcttttt

SEQ ID NO: 29791 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tttgagttaattgtcattct

SEQ ID NO: 29792 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
aatatttattgaatactgaa

SEQ ID NO: 29793 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
ccatcacatgtgttcgcagg

SEQ ID NO: 29794 - DNA, 20 bp, Artificial Sequence
  Description of Artificial Sequence: Synthetic oligonucleotide
  Target: ATXN1; (-) strand; PAM type: NNNNGHTT; PAM sequence: ATACGTTT
acttagacctggtcttggaa

SEQ ID NO: 29795 - DNA, 20 bp, Artificial Sequence
  Description of Artificial Sequence: Synthetic oligonucleotide
  Target: ATXN1; (-) strand; PAM type: NNNNGHTT; PAM sequence: ATTAGATT
actttggatcttaagataac

SEQ ID NO: 29796 - DNA, 20 bp, Artificial Sequence
  Description of Artificial Sequence: Synthetic oligonucleotide
  Target: ATXN1; (-) strand; PAM type: NNNNGHTT; PAM sequence: CCAGGTTT
ctaaaaatacaaaaaattag

SEQ ID NO: 29797 - DNA, 20 bp, Artificial Sequence
  Description of Artificial Sequence: Synthetic oligonucleotide
  Target: ATXN1; (-) strand; PAM type: NNNNGHTT; PAM sequence: TCATGCTT
ttagggccgggcgtgatggc

SEQ ID NO: 29798 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
ttgggaggctgaggcaggag

SEQ ID NO: 29799 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
cgggtggatcacctgaggtc

SEQ ID NO: 29800 - DNA, 20 bp, Artificial Sequence
  Description of Artificial Sequence: Synthetic oligonucleotide
  Target: ATXN1; (-) strand; PAM type: NNNNGHTT; PAM sequence: CTGGGCTT
aggactagtttacagcagag

SEQ ID NO: 29801 - DNA, 20 bp, Artificial Sequence
  Description of Artificial Sequence: Synthetic oligonucleotide
  Target: ATXN1; (-) strand; PAM type: NNNNGHTT; PAM sequence: ACTAGTTT
ctttcccaaggccacaaagg

SEQ ID NO: 29802 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
cacttcacagatgtagaaac

SEQ ID NO: 29803 - DNA, 20 bp, Artificial Sequence
  Description of Artificial Sequence: Synthetic oligonucleotide
  Target: ATXN1; (-) strand; PAM type: NNNNGHTT; PAM sequence: CCAGGTTT
cttaattctcccttatatgt

SEQ ID NO: 29804 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
aagtggatcatgaaacatgt

SEQ ID NO: 29805 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
tataacactgacacattggg

SEQ ID NO: 29806 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
cttcactcttagaacttccc

SEQ ID NO: 29807 - DNA, 20 bp, Artificial Sequence
  Description of Artificial Sequence: Synthetic oligonucleotide
  Target: ATXN1; (-) strand; PAM type: NNNNGHTT; PAM sequence: ACAGGCTT
ttttgacctatcagatggaa

SEQ ID NO: 29808 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
cattttgatgtaaagcaaga

SEQ ID NO: 29809 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
atatgcttgacccaaggtat

SEQ ID NO: 29810 - DNA, 20 bp, Artificial Sequence
  Description of Artificial Sequence: Synthetic oligonucleotide
  Target: ATXN1; (-) strand; PAM type: NNNNGHTT; PAM sequence: ATATGCTT
ccatctttaggaatttgggg

SEQ ID NO: 29811 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
aggatctgtgatcaatttct

SEQ ID NO: 29812 - DNA, 20 bp, Artificial Sequence
  Description of Artificial Sequence: Synthetic oligonucleotide
  Target: ATXN1; (-) strand; PAM type: NNNNGHTT; PAM sequence: CACCGATT
gtagaatcctattgtctcac

SEQ ID NO: 29813 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
ctttaatgtttcatttacta

SEQ ID NO: 29814 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
cttttttctccatgagactt

SEQ ID NO: 29815 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
catagcaatttcagctggag

SEQ ID NO: 29816 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
gaacagatctggactaaagc

SEQ ID NO: 29817 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
gacagatgtagagcaggttt

SEQ ID NO: 29818 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
ggcagacagatgtagagcag

SEQ ID NO: 29819 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
gataggcagacagatgtaga

SEQ ID NO: 29820 - DNA, 20 bp, Artificial Sequence
  Description of Artificial Sequence: Synthetic oligonucleotide
  Target: ATXN1; (-) strand; PAM type: NNNNGHTT; PAM sequence: CAATGATT
ccttctcactggtccagctg

SEQ ID NO: 29821 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
cataggcttaatgaacccag

SEQ ID NO: 29822 - DNA, 20 bp, Artificial Sequence
  Description of Artificial Sequence: Synthetic oligonucleotide
  Target: ATXN1; (-) strand; PAM type: NNNNGHTT; PAM sequence: ATAGGCTT
gcatgggcagagggtaggtc

SEQ ID NO: 29823 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
gcagattattgcttctcccc

SEQ ID NO: 29824 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
ggcctggttattcagcagat

SEQ ID NO: 29825 - DNA, 20 bp, Artificial Sequence
  Description of Artificial Sequence: Synthetic oligonucleotide
  Target: ATXN1; (-) strand; PAM type: NNNNGHTT; PAM sequence: AGCAGATT
cagctggggcctggttattc

SEQ ID NO: 29826 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
cactttgcctgtaataatgt

SEQ ID NO: 29827 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
gccagtcactttgcctgtaa

SEQ ID NO: 29828 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
tacacgtagattgtcagaca

SEQ ID NO: 29829 - DNA, 20 bp, Artificial Sequence
  Description of Artificial Sequence: Synthetic oligonucleotide
  Target: ATXN1; (-) strand; PAM type: NNNNGHTT; PAM sequence: CGTAGATT
tgtaaaaagttaggcttaca

SEQ ID NO: 29830 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
acaccaagtaatgtaaaaag

SEQ ID NO: 29831 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
atatttgtgggaaatggatg

SEQ ID NO: 29832 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
ttctgattcagccttttatg

SEQ ID NO: 29833 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
aagagaatcccaacacacat

SEQ ID NO: 29834 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
agtgctctgtcagaatctct

SEQ ID NO: 29835 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
ccagcgttcagtccatttta

SEQ ID NO: 29836 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
gccctggacaccagacacta

SEQ ID NO: 29837 - DNA, 20 bp, Artificial Sequence
  Description of Artificial Sequence: Synthetic oligonucleotide
  Target: ATXN1; (-) strand; PAM type: NNNNGHTT; PAM sequence: TTATGCTT
tggccatgggcatggaggac

SEQ ID NO: 29838 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
attctgaacttctccctgac

SEQ ID NO: 29839 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
ggggttcttccttgcatggt

SEQ ID NO: 29840 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
ttaaaaatgtactagaccag

SEQ ID NO: 29841 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
cctttcctcggtcttaagct

SEQ ID NO: 29842 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
gtccttataagcccaatgtt

SEQ ID NO: 29843 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tcctttatttcttggatgtt

SEQ ID NO: 29844 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
gtcttcttcctttatttctt

SEQ ID NO: 29845 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
caaatcacatcttgtctgaa

SEQ ID NO: 29846 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ttttgtaagttggtgtttct

SEQ ID NO: 29847 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
cctaatttttttttgtaagt

SEQ ID NO: 29848 - DNA, 20 bp, Artificial Sequence
  Description of Artificial Sequence: Synthetic oligonucleotide
  Target: ATXN1; (-) strand; PAM type: NNNNGHTT; PAM sequence: TGTAGTTT
ttccttttcattgcatcgaa

SEQ ID NO: 29849 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
tgctggtttgatgctccaaa

SEQ ID NO: 29850 - DNA, 20 bp, Artificial Sequence
  Description of Artificial Sequence: Synthetic oligonucleotide
  Target: ATXN1; (-) strand; PAM type: NNNNGHTT; PAM sequence: GCTGGTTT
ttcaggtttgttcttcactt

SEQ ID NO: 29851 - DNA, 20 bp, Artificial Sequence
  Description of Artificial Sequence: Synthetic oligonucleotide
  Target: ATXN1; (-) strand; PAM type: NNNNGHTT; PAM sequence: TCAGGTTT
gtgccttttgggagactttt

SEQ ID NO: 29852 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tatccattagcatctatctg

SEQ ID NO: 29853 - DNA, 20 bp, Artificial Sequence
  Description of Artificial Sequence: Synthetic oligonucleotide
  Target: ATXN1; (-) strand; PAM type: NNNNGHTT; PAM sequence: ATCTGATT
tcctgtatccattagcatct

SEQ ID NO: 29854 - DNA, 20 bp, Artificial Sequence
  Description of Artificial Sequence: Synthetic oligonucleotide
  Target: ATXN1; (-) strand; PAM type: NNNNGHTT; PAM sequence: GTTGGCTT
atcaatcatgctatctctat

SEQ ID NO: 29855 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
tctttcattatttctttaat

SEQ ID NO: 29856 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gttggtttactctgtatttc

SEQ ID NO: 29857 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
gttggttggttggttggttg

SEQ ID NO: 29858 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
tttttttcttcttgtataga

SEQ ID NO: 29859 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
taatttatattaatatttat

SEQ ID NO: 29860 - DNA, 20 bp, Artificial Sequence
  Description of Artificial Sequence: Synthetic oligonucleotide
  Target: ATXN1; (-) strand; PAM type: NNNNGHTT; PAM sequence: GGAAGTTT
cagaaggtaaataaatagat

SEQ ID NO: 29861 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
ctcctcactgaatgcttatg

SEQ ID NO: 29862 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
tatttcttttcctcctcact

SEQ ID NO: 29863 - DNA, 20 bp, Artificial Sequence
  Description of Artificial Sequence: Synthetic oligonucleotide
  Target: ATXN1; (-) strand; PAM type: NNNNGHTT; PAM sequence: ATCTGATT
tatttcttctattgtcagaa

SEQ ID NO: 29864 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
ctttgccattagagctgtgt

SEQ ID NO: 29865 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
ataccttagtaggaaagttg

SEQ ID NO: 29866 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
aatatattctatgaaataca

SEQ ID NO: 29867 - DNA, 20 bp, Artificial Sequence
  Description of Artificial Sequence: Synthetic oligonucleotide
  Target: ATXN1; (-) strand; PAM type: NNNNGHTT; PAM sequence: GGGAGCTT
attaaatttttgattgatta

SEQ ID NO: 29868 - DNA, 20 bp, Artificial Sequence
  Description of Artificial Sequence: Synthetic oligonucleotide
  Target: ATXN1; (-) strand; PAM type: NNNNGHTT; PAM sequence: GATTGATT
ttgtttaaaattaaattttt

SEQ ID NO: 29869 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
tttattgtttaaaattaaat

SEQ ID NO: 29870 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
gcacaactaccccttttctt

SEQ ID NO: 29871 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
gggcctgaatccatattgtg

SEQ ID NO: 29872 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cacctcggcctcccaaagtt

SEQ ID NO: 29873 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
cgtctcgatgtgttgtcccg

SEQ ID NO: 29874 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
tcctttttataacgatattc

SEQ ID NO: 29875 - DNA, 20 bp, Artificial Sequence
  Description of Artificial Sequence: Synthetic oligonucleotide
  Target: ATXN1; (-) strand; PAM type: NNNNGHTT; PAM sequence: TAAGGATT
tattatgtaacttttcttaa

SEQ ID NO: 29876 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
tatagatgttttgatccagt

SEQ ID NO: 29877 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
tagacatatagatgttttga

SEQ ID NO: 29878 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
aaagttagatatagacatat

SEQ ID NO: 29879 - DNA, 20 bp, Artificial Sequence
  Description of Artificial Sequence: Synthetic oligonucleotide
  Target: ATXN1; (-) strand; PAM type: NNNNGHTT; PAM sequence: ATAAGATT
atacctcctccctgtataag

SEQ ID NO: 29880 - DNA, 20 bp, Artificial Sequence
  Description of Artificial Sequence: Synthetic oligonucleotide
  Target: ATXN1; (-) strand; PAM type: NNNNGHTT; PAM sequence: ATATGATT
ctcattttccattttgtgtg

SEQ ID NO: 29881 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
atctttttattcttttggtt

SEQ ID NO: 29882 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
ttttgtcatctttttattct

SEQ ID NO: 29883 - DNA, 20 bp, Artificial Sequence
  Description of Artificial Sequence: Synthetic oligonucleotide
  Target: ATXN1; (-) strand; PAM type: NNNNGHTT; PAM sequence: ATACGCTT
aatacctgtcttcaatgttg

SEQ ID NO: 29884 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tatgacaccatctgagattc

SEQ ID NO: 29885 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
ttcttaatttatgacaccat

SEQ ID NO: 29886 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
ccaatcttcttgtaactttt

SEQ ID NO: 29887 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
aaaactgtcacttctaaatg

SEQ ID NO: 29888 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
tgaatgctttagatatgtaa

SEQ ID NO: 29889 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
gtaaaaatttcacccctgtt

SEQ ID NO: 29890 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
attattgcatgtctctcaat

SEQ ID NO: 29891 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
aaaaaaaaaaaaaaaatttc

SEQ ID NO: 29892 - DNA, 20 bp, Artificial Sequence
  Description of Artificial Sequence: Synthetic oligonucleotide
  Target: ATXN1; (-) strand; PAM type: NNNNGHTT; PAM sequence: CGGAGCTT
aatggcatgaacccaggagg

SEQ ID NO: 29893 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
tgtcatcagatctgccatat

SEQ ID NO: 29894 - DNA, 20 bp, Artificial Sequence
  Description of Artificial Sequence: Synthetic oligonucleotide
  Target: ATXN1; (-) strand; PAM type: NNNNGHTT; PAM sequence: TCAGGCTT
catgctctaattaaatctaa

SEQ ID NO: 29895 - DNA, 20 bp, Artificial Sequence
  Description of Artificial Sequence: Synthetic oligonucleotide
  Target: ATXN1; (-) strand; PAM type: NNNNGHTT; PAM sequence: ACAGGATT
aatttattttatgttccaat

SEQ ID NO: 29896 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
gtttacacttctgtctatta

SEQ ID NO: 29897 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
tgaatgtacaagttaatttg

SEQ ID NO: 29898 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
attatctttattgtctcagt

SEQ ID NO: 29899 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
ctgcccgacctcccaaagtg

SEQ ID NO: 29900 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
ttttgtatttttagtacaga

SEQ ID NO: 29901 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctccaccttacgggttc

SEQ ID NO: 29902 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
tttcctttatattgcttttc

SEQ ID NO: 29903 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
ttttatgtgcttttccttta

SEQ ID NO: 29904 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
tctcacatttggatagtttt

SEQ ID NO: 29905 - DNA, 20 bp, Artificial Sequence
  Description of Artificial Sequence: Synthetic oligonucleotide
  Target: ATXN1; (-) strand; PAM type: NNNNGHTT; PAM sequence: GATAGTTT
taatttttatctcacatttg

SEQ ID NO: 29906 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgcctcggcctcccaaagtg

SEQ ID NO: 29907 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttgtatttttagtagaga

SEQ ID NO: 29908 - DNA, 20 bp, Artificial Sequence
  Description of Artificial Sequence: Synthetic oligonucleotide
  Target: ATXN1; (-) strand; PAM type: NNNNGHTT; PAM sequence: CTCCGCTT
caatctcggctcactgcaag

SEQ ID NO: 29909 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
tttggtttgttctctgaaac

SEQ ID NO: 29910 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
attccacttcttatttttaa

SEQ ID NO: 29911 - DNA, 20 bp, Artificial Sequence
  Description of Artificial Sequence: Synthetic oligonucleotide
  Target: ATXN1; (-) strand; PAM type: NNNNGHTT; PAM sequence: TGGGGATT
tgcctcagcctcccaaagca

SEQ ID NO: 29912 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
aaattaatattaaagcattt

SEQ ID NO: 29913 - DNA, 20 bp, Artificial Sequence
  Description of Artificial Sequence: Synthetic oligonucleotide
  Target: ATXN1; (-) strand; PAM type: NNNNGHTT; PAM sequence: TCAGGATT
gtctataataatttttttga

SEQ ID NO: 29914 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
atgaaagcctccccacccct

SEQ ID NO: 29915 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
taaggcacatgtagcatcct

SEQ ID NO: 29916 - DNA, 20 bp, Artificial Sequence
  Description of Artificial Sequence: Synthetic oligonucleotide
  Target: ATXN1; (-) strand; PAM type: NNNNGHTT; PAM sequence: AGCAGCTT
aaatgggcaagctgacatat

SEQ ID NO: 29917 - DNA, 20 bp, Artificial Sequence
  Description of Artificial Sequence: Synthetic oligonucleotide
  Target: ATXN1; (-) strand; PAM type: NNNNGHTT; PAM sequence: CGGGGATT
aagagtcatgtaccatcaag

SEQ ID NO: 29918 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
ttgtctattgaatggtgatg

SEQ ID NO: 29919 - DNA, 20 bp, Artificial Sequence
  Description of Artificial Sequence: Synthetic oligonucleotide
  Target: ATXN1; (-) strand; PAM type: NNNNGHTT; PAM sequence: GGCCGCTT
atttaagagaaaaccttttt

SEQ ID NO: 29920 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
cttttaatataatattggct

SEQ ID NO: 29921 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
gcctgaatttaatcattgac

SEQ ID NO: 29922 - DNA, 20 bp, Artificial Sequence
  Description of Artificial Sequence: Synthetic oligonucleotide
  Target: ATXN1; (-) strand; PAM type: NNNNGHTT; PAM sequence: ACCCGCTT
ctcctgacctcaagtgatcc

SEQ ID NO: 29923 - DNA, 20 bp, Artificial Sequence
  Description of Artificial Sequence: Synthetic oligonucleotide
  Target: ATXN1; (-) strand; PAM type: NNNNGHTT; PAM sequence: CGGAGTTT
ttttgtatttttagtagaga

SEQ ID NO: 29924 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
ggcctcagactcccaagtat

SEQ ID NO: 29925 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctctgcctcccaggctc

SEQ ID NO: 29926 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
aaattaatattaaagcattt

SEQ ID NO: 29927 - DNA, 20 bp, Artificial Sequence
  Description of Artificial Sequence: Synthetic oligonucleotide
  Target: ATXN1; (-) strand; PAM type: NNNNGHTT; PAM sequence: TCAGGATT
gtctataataatttttttga

SEQ ID NO: 29928 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
atgaaagcctccccacccct

SEQ ID NO: 29929 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
taaggcacatgtagcatcct

SEQ ID NO: 29930 - DNA, 20 bp, Artificial Sequence
  Description of Artificial Sequence: Synthetic oligonucleotide
  Target: ATXN1; (-) strand; PAM type: NNNNGHTT; PAM sequence: AGCAGCTT
aaatgggcaagctgacatat

SEQ ID NO: 29931 - DNA, 20 bp, Artificial Sequence
  Description of Artificial Sequence: Synthetic oligonucleotide
  Target: ATXN1; (-) strand; PAM type: NNNNGHTT; PAM sequence: CGGGGATT
aagagtcatgtaccatcaag

SEQ ID NO: 29932 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
ttgtctattgaatggtgatg

SEQ ID NO: 29933 - DNA, 20 bp, Artificial Sequence
  Description of Artificial Sequence: Synthetic oligonucleotide
  Target: ATXN1; (-) strand; PAM type: NNNNGHTT; PAM sequence: GGCCGCTT
atttaagagaaaaccttttt

SEQ ID NO: 29934 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
cttttaatataatattggct

SEQ ID NO: 29935 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
gcctgaatttaatcattgac

SEQ ID NO: 29936 - DNA, 20 bp, Artificial Sequence
  Description of Artificial Sequence: Synthetic oligonucleotide
  Target: ATXN1; (-) strand; PAM type: NNNNGHTT; PAM sequence: CGGAGTTT
ttttgtatttttagtagaga

SEQ ID NO: 29937 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
ggccacagactcccaaatat

SEQ ID NO: 29938 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctctgcctcccaggctc

SEQ ID NO: 29939 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
caccttggcctcccaaaatg

SEQ ID NO: 29940 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtatttttagtagaga

SEQ ID NO: 29941 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgtctcagcctcccaagtat

SEQ ID NO: 29942 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
agcctctgcctcccaggttc

SEQ ID NO: 29943 - DNA, 20 bp, Artificial Sequence
  Description of Artificial Sequence: Synthetic oligonucleotide
  Target: ATXN1; (-) strand; PAM type: NNNNGHTT; PAM sequence: TTGCGTTT
aaattttcacctgattatca

SEQ ID NO: 29944 - DNA, 20 bp, Artificial Sequence
  Description of Artificial Sequence: Synthetic oligonucleotide
  Target: ATXN1; (-) strand; PAM type: NNNNGHTT; PAM sequence: ACCTGATT
actgtataagggaaattttc

SEQ ID NO: 29945 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
ataaaattcaatgtataaat

SEQ ID NO: 29946 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
agtaccaaaccctatataga

SEQ ID NO: 29947 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
ccagttagtaccaaacccta

SEQ ID NO: 29948 - DNA, 20 bp, Artificial Sequence
  Description of Artificial Sequence: Synthetic oligonucleotide
  Target: ATXN1; (-) strand; PAM type: NNNNGHTT; PAM sequence: GGTGGATT
ggggcatgttccatacccct

SEQ ID NO: 29949 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
tgagcagttcttgttttctt

SEQ ID NO: 29950 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
ttttatagaatctgagcagt

SEQ ID NO: 29951 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
tagttttttagtaatgcatt

SEQ ID NO: 29952 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
tccatgcacaatgtttttcc

SEQ ID NO: 29953 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
tgtaatttttgatccatgca

SEQ ID NO: 29954 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
ttcaaaataaaatttaattt

SEQ ID NO: 29955 - DNA, 20 bp, Artificial Sequence
  Description of Artificial Sequence: Synthetic oligonucleotide
  Target: ATXN1; (-) strand; PAM type: NNNNGHTT; PAM sequence: GTCAGATT
tgtgtacatagactaattta

SEQ ID NO: 29956 - DNA, 20 bp, Artificial Sequence
  Description of Artificial Sequence: Synthetic oligonucleotide
  Target: ATXN1; (-) strand; PAM type: NNNNGHTT; PAM sequence: ATTAGATT
gtttagaagattttaatata

SEQ ID NO: 29957 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
gcttttgattctatgagttt

SEQ ID NO: 29958 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
tctattttgcttttgattct

SEQ ID NO: 29959 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
ttgttttttttctattttgc

SEQ ID NO: 29960 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tgatatttgttttttttcta

SEQ ID NO: 29961 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
ttatattctgttatcttgat

SEQ ID NO: 29962 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
gtgtgtgtttttagtagaga

SEQ ID NO: 29963 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
cacgcccggctaatttttgt

SEQ ID NO: 29964 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
ttttttttttttttttgaga

SEQ ID NO: 29965 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
attaagtactaataaaaact

SEQ ID NO: 29966 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
ttgatgtgcgatcttagaca

SEQ ID NO: 29967 - DNA, 20 bp, Artificial Sequence
  Description of Artificial Sequence: Synthetic oligonucleotide
  Target: ATXN1; (-) strand; PAM type: NNNNGHTT; PAM sequence: TATCGTTT
attatctcatagtttatatt

SEQ ID NO: 29968 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
attgtagttctttattatct

SEQ ID NO: 29969 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
aatttttttttaattttttt

SEQ ID NO: 29970 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
gtttgctgagaatgatggtt

SEQ ID NO: 29971 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
tgggttagtttgctgagaat

SEQ ID NO: 29972 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
gtttggttttctgttcctgg

SEQ ID NO: 29973 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
atgagtgagaacatgcggtg

SEQ ID NO: 29974 - DNA, 20 bp, Artificial Sequence
  Description of Artificial Sequence: Synthetic oligonucleotide
  Target: ATXN1; (-) strand; PAM type: NNNNGHTT; PAM sequence: CGGTGTTT
cacttatgagtgagaacatg

SEQ ID NO: 29975 - DNA, 20 bp, Artificial Sequence
  Description of Artificial Sequence: Synthetic oligonucleotide
  Target: ATXN1; (-) strand; PAM type: NNNNGHTT; PAM sequence: CTAGGTTT
tgtacctatcaacctgtcat

SEQ ID NO: 29976 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
cataggtatacatgtgccat

SEQ ID NO: 29977 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
gggatacacgtgcagaactt

SEQ ID NO: 29978 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tgcctgaattcttttgtttt

SEQ ID NO: 29979 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
accctgcctgaattcttttg

SEQ ID NO: 29980 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
accacaccctgcctgaattc

SEQ ID NO: 29981 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcggcctcccaaagtg

SEQ ID NO: 29982 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
tcttgtatttttagtagaga

SEQ ID NO: 29983 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
ctcccgggttcaagcgattc

SEQ ID NO: 29984 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctccgcctcccgggttc

SEQ ID NO: 29985 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
ttaataattttcaaaaagtg

SEQ ID NO: 29986 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
gcatattaataattttcaaa

SEQ ID NO: 29987 - DNA, 20 bp, Artificial Sequence
  Description of Artificial Sequence: Synthetic oligonucleotide
  Target: ATXN1; (-) strand; PAM type: NNNNGHTT; PAM sequence: CGTTGATT
tttcctttgaattttactta

SEQ ID NO: 29988 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
ttgtattaaggatattaact

SEQ ID NO: 29989 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
cattgcttatttttgtctta

SEQ ID NO: 29990 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
ttaaattggccattcgtgtt

SEQ ID NO: 29991 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
tggatattttccttatgttt

SEQ ID NO: 29992 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
agtgagggtggatattttcc

SEQ ID NO: 29993 - DNA, 20 bp, Artificial Sequence
  Description of Artificial Sequence: Synthetic oligonucleotide
  Target: ATXN1; (-) strand; PAM type: NNNNGHTT; PAM sequence: TGTAGTTT
ttttaatttgctttttttag

SEQ ID NO: 29994 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
aaaaattatatcttgtttta

SEQ ID NO: 29995 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
ttgataagttaaaaattata

SEQ ID NO: 29996 - DNA, 20 bp, Artificial Sequence
  Description of Artificial Sequence: Synthetic oligonucleotide
  Target: ATXN1; (-) strand; PAM type: NNNNGHTT; PAM sequence: TAAGGCTT
tcaaatagtaaggcccttta

SEQ ID NO: 29997 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
tatcttttttcaacatctct

SEQ ID NO: 29998 - DNA, 20 bp, Artificial Sequence
  Description of Artificial Sequence: Synthetic oligonucleotide
  Target: ATXN1; (-) strand; PAM type: NNNNGHTT; PAM sequence: TATCGTTT
taattttccagatattgtgc

SEQ ID NO: 29999 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
gtgtgatcttagggcctatc

SEQ ID NO: 30000 - DNA, 20 bp, Artificial Sequence
  Description of Artificial Sequence: Synthetic oligonucleotide
  Target: ATXN1; (-) strand; PAM type: NNNNGHTT; PAM sequence: GTGTGATT
tatattgtaaacatgctgct

SEQ ID NO: 30001 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
taactgggatcatgctgatt

SEQ ID NO: 30002 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
agattttttaactgggatca

SEQ ID NO: 30003 - DNA, 20 bp, Artificial Sequence
  Description of Artificial Sequence: Synthetic oligonucleotide
  Target: ATXN1; (-) strand; PAM type: NNNNGHTT; PAM sequence: TATAGATT
atttttagtgtctctagtca

SEQ ID NO: 30004 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
ggcatgccccagaaattgtt

SEQ ID NO: 30005 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
actccagggcatgccccaga

SEQ ID NO: 30006 - DNA, 20 bp, Artificial Sequence
  Description of Artificial Sequence: Synthetic oligonucleotide
  Target: ATXN1; (-) strand; PAM type: NNNNGHTT; PAM sequence: CTATGATT
tgccacgcatggctatagag

SEQ ID NO: 30007 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
cagatcttaaagtgatagag

SEQ ID NO: 30008 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
tatggtccagatgctgtact

SEQ ID NO: 30009 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
aaagtttggttgaggggggt

SEQ ID NO: 30010 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
atcaaggtttctcctactgt

SEQ ID NO: 30011 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
ctctagcatagaaataagat

SEQ ID NO: 30012 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
tgtttacagcctttgaagac

SEQ ID NO: 30013 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
gtatgtgaatatttaacatt

SEQ ID NO: 30014 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
gtgtgtgtgtgtgtgtgtgt

SEQ ID NO: 30015 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
ggagaattgaatgctagata

SEQ ID NO: 30016 - DNA, 20 bp, Artificial Sequence
  Description of Artificial Sequence: Synthetic oligonucleotide
  Target: ATXN1; (-) strand; PAM type: NNNNGHTT; PAM sequence: TAAAGATT
atctccttaaagatgcatat

SEQ ID NO: 30017 - DNA, 20 bp, Artificial Sequence
  Description of Artificial Sequence: Synthetic oligonucleotide
  Target: ATXN1; (-) strand; PAM type: NNNNGHTT; PAM sequence: TCTAGCTT
acctctgttttcttagatca

SEQ ID NO: 30018 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
gccaactgatgatcaacaac

SEQ ID NO: 30019 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
aagggccccagagagttctc

SEQ ID NO: 30020 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
ttatcttttaattttctttc

SEQ ID NO: 30021 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
aatgctttcatggatgccag

SEQ ID NO: 30022 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
ataacatgaacagggaaagc

SEQ ID NO: 30023 - DNA, 20 bp, Artificial Sequence
  Description of Artificial Sequence: Synthetic oligonucleotide
  Target: ATXN1; (-) strand; PAM type: NNNNGHTT; PAM sequence: GCTAGATT
catttgtctctttctacact

SEQ ID NO: 30024 - DNA, 20 bp, Artificial Sequence
  Description of Artificial Sequence: Synthetic oligonucleotide
  Target: ATXN1; (-) strand; PAM type: NNNNGHTT; PAM sequence: CCGTGTTT
tcttgcagctaacgcccttg

SEQ ID NO: 30025 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
gtgtctccttttagggctat

SEQ ID NO: 30026 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
gcatgagccgccgggcctgg

SEQ ID NO: 30027 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
tgccttggcctcccaaagtg

SEQ ID NO: 30028 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
agcctcagcctccctagtag

SEQ ID NO: 30029 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
catttgtttaattctttgtt

SEQ ID NO: 30030 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
aactcatcatttgtttaatt

SEQ ID NO: 30031 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tttcgggctatcaactcatc

SEQ ID NO: 30032 - DNA, 20 bp, Artificial Sequence
  Description of Artificial Sequence: Synthetic oligonucleotide
  Target: ATXN1; (-) strand; PAM type: NNNNGHTT; PAM sequence: CCCAGCTT
aaactactcgcccacattta

SEQ ID NO: 30033 - DNA, 20 bp, Artificial Sequence
  Description of Artificial Sequence: Synthetic oligonucleotide
  Target: ATXN1; (-) strand; PAM type: NNNNGHTT; PAM sequence: GATAGATT
tttaaaaatggtggcactca

SEQ ID NO: 30034 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
agttattgctgttactattc

SEQ ID NO: 30035 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
atctgtcacttgtgtatttc

SEQ ID NO: 30036 - DNA, 20 bp, Artificial Sequence
  Description of Artificial Sequence: Synthetic oligonucleotide
  Target: ATXN1; (-) strand; PAM type: NNNNGHTT; PAM sequence: CCATGCTT
taagtctgtggaagcagagc

SEQ ID NO: 30037 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
tccttattgcacttacacat

SEQ ID NO: 30038 - DNA, 20 bp, Artificial Sequence
  Description of Artificial Sequence: Synthetic oligonucleotide
  Target: ATXN1; (-) strand; PAM type: NNNNGHTT; PAM sequence: ACCGGTTT
catcagtttttatccccttc

SEQ ID NO: 30039 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
tactctaaaataacaccctc

SEQ ID NO: 30040 - DNA, 20 bp, Artificial Sequence
  Description of Artificial Sequence: Synthetic oligonucleotide
  Target: ATXN1; (-) strand; PAM type: NNNNGHTT; PAM sequence: TACCGTTT
gagccctgagctaagctcct

SEQ ID NO: 30041 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
catcaccatctcctagagca

SEQ ID NO: 30042 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
gcacatcccttgtactcttt

SEQ ID NO: 30043 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
attcgcacatcccttgtact

SEQ ID NO: 30044 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
ctttaataaatgaaaattag

SEQ ID NO: 30045 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
agaagcttttcttgaatgat

SEQ ID NO: 30046 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
ctgaaatagaatttttggag

SEQ ID NO: 30047 - DNA, 20 bp, Artificial Sequence
  Description of Artificial Sequence: Synthetic oligonucleotide
  Target: ATXN1; (-) strand; PAM type: NNNNGHTT; PAM sequence: ACTCGTTT
ttagaaagacatggattaga

SEQ ID NO: 30048 - DNA, 20 bp, Artificial Sequence
  Description of Artificial Sequence: Synthetic oligonucleotide
  Target: ATXN1; (-) strand; PAM type: NNNNGHTT; PAM sequence: CATGGATT
aggctagaagcttagaaaga

SEQ ID NO: 30049 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
acagttaaaaaaaaaaggct

SEQ ID NO: 30050 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
tgcagaaaaattcaaaatat

SEQ ID NO: 30051 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
aaaataaacccaaactactt

SEQ ID NO: 30052 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
acagctttatttgtgttaat

SEQ ID NO: 30053 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
gagacatggaggctctccag

SEQ ID NO: 30054 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
gactcagcaattttccttct

SEQ ID NO: 30055 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
caagtttgaaaaatggcatt

SEQ ID NO: 30056 - DNA, 20 bp, Artificial Sequence
  Description of Artificial Sequence: Synthetic oligonucleotide
  Target: ATXN1; (-) strand; PAM type: NNNNGHTT; PAM sequence: CCAAGTTT
ccagtaatgaatattttggt

SEQ ID NO: 30057 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
aagtctggatttgttcaaag

SEQ ID NO: 30058 - DNA, 20 bp, Artificial Sequence
  Description of Artificial Sequence: Synthetic oligonucleotide
  Target: ATXN1; (-) strand; PAM type: NNNNGHTT; PAM sequence: TCTGGATT
agaatggaaatttcttcaag

SEQ ID NO: 30059 - DNA, 20 bp, Artificial Sequence
  Description of Artificial Sequence: Synthetic oligonucleotide
  Target: ATXN1; (-) strand; PAM type: NNNNGHTT; PAM sequence: AGTTGATT
ggggtattgtttgcttgcgt

SEQ ID NO: 30060 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
tgttgttcttatggggtatt

SEQ ID NO: 30061 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
ttattgttgttcttatgggg

SEQ ID NO: 30062 - DNA, 20 bp, Artificial Sequence
  Description of Artificial Sequence: Synthetic oligonucleotide
  Target: ATXN1; (-) strand; PAM type: NNNNGHTT; PAM sequence: ATGTGATT
tgcttcctggagccagcaat

SEQ ID NO: 30063 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
ctttaatttaaatgtcttca

SEQ ID NO: 30064 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
cagaatatttttgtaagcat

SEQ ID NO: 30065 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
tagccagaatatttttgtaa

SEQ ID NO: 30066 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
ctagattattcttagtttgg

SEQ ID NO: 30067 - DNA, 20 bp, Artificial Sequence
  Description of Artificial Sequence: Synthetic oligonucleotide
  Target: ATXN1; (-) strand; PAM type: NNNNGHTT; PAM sequence: CTTAGTTT
ggggaaatatctagattatt

SEQ ID NO: 30068 - DNA, 20 bp, Artificial Sequence
  Description of Artificial Sequence: Synthetic oligonucleotide
  Target: ATXN1; (-) strand; PAM type: NNNNGHTT; PAM sequence: TCTAGATT
acagaagattgggggaaata

SEQ ID NO: 30069 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
gccatgaactaaatgggaac

SEQ ID NO: 30070 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
tccttagttctcagacacac

SEQ ID NO: 30071 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
ttttagtctattcacatcgg

SEQ ID NO: 30072 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
attcacaaactgcagaattg

SEQ ID NO: 30073 - DNA, 20 bp, Artificial Sequence
  Description of Artificial Sequence: Synthetic oligonucleotide
  Target: ATXN1; (-) strand; PAM type: NNNNGHTT; PAM sequence: ACCAGCTT
ttagctgctatattattaat

SEQ ID NO: 30074 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
acagtatttgtccttttatg

SEQ ID NO: 30075 - DNA, 20 bp, Artificial Sequence
  Description of Artificial Sequence: Synthetic oligonucleotide
  Target: ATXN1; (-) strand; PAM type: NNNNGHTT; PAM sequence: AACTGCTT
ttctcccccaagcccttggc

SEQ ID NO: 30076 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cacctcggcctcccaaagtg

SEQ ID NO: 30077 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttctgtatttttagtagaga

SEQ ID NO: 30078 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgccccagcctcccaagtag

SEQ ID NO: 30079 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
tgatctcagttcactgcaac

SEQ ID NO: 30080 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
ctgaaacaaaacaccgccac

SEQ ID NO: 30081 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
tatgaaggaataacccttct

SEQ ID NO: 30082 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
tgattatgaaggaataaccc

SEQ ID NO: 30083 - DNA, 20 bp, Artificial Sequence
  Description of Artificial Sequence: Synthetic oligonucleotide
  Target: ATXN1; (-) strand; PAM type: NNNNGHTT; PAM sequence: ATATGATT
caatctatggtgcagaatgt

SEQ ID NO: 30084 - DNA, 20 bp, Artificial Sequence
  Description of Artificial Sequence: Synthetic oligonucleotide
  Target: ATXN1; (-) strand; PAM type: NNNNGHTT; PAM sequence: TATAGCTT
atttgtgcactgaaatttgg

SEQ ID NO: 30085 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
atattcagttaaatttaagc

SEQ ID NO: 30086 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
gcagaaacaaaggttgaagc

SEQ ID NO: 30087 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
caaaaacaagtatttcatgg

SEQ ID NO: 30088 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
ttccattcccagtaatcgtt

SEQ ID NO: 30089 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
ggatggcatcaaagaggctt

SEQ ID NO: 30090 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
aggcataaggatggcatcaa

SEQ ID NO: 30091 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
tcgatgtgggagtgggagtg

SEQ ID NO: 30092 - DNA, 20 bp, Artificial Sequence
  Description of Artificial Sequence: Synthetic oligonucleotide
  Target: ATXN1; (-) strand; PAM type: NNNNGHTT; PAM sequence: TGAAGATT
ttccttgcatctgggactgt

SEQ ID NO: 30093 - DNA, 20 bp, Artificial Sequence
  Description of Artificial Sequence: Synthetic oligonucleotide
  Target: ATXN1; (-) strand; PAM type: NNNNGHTT; PAM sequence: GTAAGCTT
cttgcctctccaaagcgatt

SEQ ID NO: 30094 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
ataaatgccttgcctctcca

SEQ ID NO: 30095 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
atatttgctgaataaatgta

SEQ ID NO: 30096 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
tggttactatacggaacccc

SEQ ID NO: 30097 - DNA, 20 bp, Artificial Sequence
  Description of Artificial Sequence: Synthetic oligonucleotide
  Target: ATXN1; (-) strand; PAM type: NNNNGHTT; PAM sequence: ACTGGATT
gccagaatgctcactcagtg

SEQ ID NO: 30098 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
gatcactattctcattccaa

SEQ ID NO: 30099 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
tcagaacatttatgtatctg

SEQ ID NO: 30100 - DNA, 20 bp, Artificial Sequence
  Description of Artificial Sequence: Synthetic oligonucleotide
  Target: ATXN1; (-) strand; PAM type: NNNNGHTT; PAM sequence: GCAAGTTT
aattcacatcttccatggtg

SEQ ID NO: 30101 - DNA, 20 bp, Artificial Sequence
  Description of Artificial Sequence: Synthetic oligonucleotide
  Target: ATXN1; (-) strand; PAM type: NNNNGHTT; PAM sequence: ACTCGTTT
ttctataccttagtacaatc

SEQ ID NO: 30102 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
ctagtgccataaatgttttt

SEQ ID NO: 30103 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
attgaaaattctagtgccat

SEQ ID NO: 30104 - DNA, 20 bp, Artificial Sequence
  Description of Artificial Sequence: Synthetic oligonucleotide
  Target: ATXN1; (-) strand; PAM type: NNNNGHTT; PAM sequence: ACTAGATT
aaataaataaatattattaa

SEQ ID NO: 30105 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
tggtgcgtgcctgtaatccc

SEQ ID NO: 30106 - DNA, 20 bp, Artificial Sequence
  Description of Artificial Sequence: Synthetic oligonucleotide
  Target: ATXN1; (-) strand; PAM type: NNNNGHTT; PAM sequence: GTATGATT
ttgattcattagttgattaa

SEQ ID NO: 30107 - DNA, 20 bp, Artificial Sequence
  Description of Artificial Sequence: Synthetic oligonucleotide
  Target: ATXN1; (-) strand; PAM type: NNNNGHTT; PAM sequence: AGTTGATT
ataagttaacttgattcatt

SEQ ID NO: 30108 - DNA, 20 bp, Artificial Sequence
  Description of Artificial Sequence: Synthetic oligonucleotide
  Target: ATXN1; (-) strand; PAM type: NNNNGHTT; PAM sequence: ACTTGATT
gtaacagtatccataagtta

SEQ ID NO: 30109 - DNA, 20 bp, Artificial Sequence
  Description of Artificial Sequence: Synthetic oligonucleotide
  Target: ATXN1; (-) strand; PAM type: NNNNGHTT; PAM sequence: TAGGGCTT
tattctgagaaactggaagt

SEQ ID NO: 30110 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ggccctttcatatgacctta

SEQ ID NO: 30111 - DNA, 20 bp, Artificial Sequence
  Description of Artificial Sequence: Synthetic oligonucleotide
  Target: ATXN1; (-) strand; PAM type: NNNNGHTT; PAM sequence: GTGGGCTT
tcttccccctgtgtcctctc

SEQ ID NO: 30112 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
ttccttctgaagtccttctc

SEQ ID NO: 30113 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
ttcttatgattctagagaca

SEQ ID NO: 30114 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
aacagcacaaacttattttc

SEQ ID NO: 30115 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
taacaaagtaacccagactg

SEQ ID NO: 30116 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
caaacaagggcttagtatct

SEQ ID NO: 30117 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
gccacagctccatctcaaac

SEQ ID NO: 30118 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
aagagactcagagaagtaaa

SEQ ID NO: 30119 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
tcacatcttagaaggtaaca

SEQ ID NO: 30120 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
tggttcaagaagcagatggg

SEQ ID NO: 30121 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cacctcggcctcccaaagtg

SEQ ID NO: 30122 - DNA, 20 bp, Artificial Sequence
  Description of Artificial Sequence: Synthetic oligonucleotide
  Target: ATXN1; (-) strand; PAM type: NNNNGHTT; PAM sequence: ATGGGATT
tgtttgtatttttagtagag

SEQ ID NO: 30123 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
cgtgagccaccacacccggc

SEQ ID NO: 30124 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
agcctctgcctcccaggttc

SEQ ID NO: 30125 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
tcctgtttttttgtttgttt

SEQ ID NO: 30126 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
aggatcctgtttttttgttt

SEQ ID NO: 30127 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
agagaggatcctgttttttt

SEQ ID NO: 30128 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gctgagagaggatcctgttt

SEQ ID NO: 30129 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
ggagacttgctgagagagga

SEQ ID NO: 30130 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
ttgtccttgtttcttcttca

SEQ ID NO: 30131 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
ggagccattcttcaccttgt

SEQ ID NO: 30132 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
tactgttctattgtagtaat

SEQ ID NO: 30133 - DNA, 20 bp, Artificial Sequence
  Description of Artificial Sequence: Synthetic oligonucleotide
  Target: ATXN1; (-) strand; PAM type: NNNNGHTT; PAM sequence: TGAAGATT
atttttatttgtgctgctat

SEQ ID NO: 30134 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
aggctgtaccaaggattggt

SEQ ID NO: 30135 - DNA, 20 bp, Artificial Sequence
  Description of Artificial Sequence: Synthetic oligonucleotide
  Target: ATXN1; (-) strand; PAM type: NNNNGHTT; PAM sequence: CAAGGATT
gatctgtacggaggctgtac

SEQ ID NO: 30136 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
gggtcatattgtatgaacag

SEQ ID NO: 30137 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
ccaaaaattcacattgaatt

SEQ ID NO: 30138 - DNA, 20 bp, Artificial Sequence
  Description of Artificial Sequence: Synthetic oligonucleotide
  Target: ATXN1; (-) strand; PAM type: NNNNGHTT; PAM sequence: CATGGATT
atgagggcacgtggatatcc

SEQ ID NO: 30139 - DNA, 20 bp, Artificial Sequence
  Description of Artificial Sequence: Synthetic oligonucleotide
  Target: ATXN1; (-) strand; PAM type: NNNNGHTT; PAM sequence: CGGGGATT
tagagggagcttctaagaaa

SEQ ID NO: 30140 - DNA, 20 bp, Artificial Sequence
  Description of Artificial Sequence: Synthetic oligonucleotide
  Target: ATXN1; (-) strand; PAM type: NNNNGHTT; PAM sequence: GGGAGCTT
agtaaaagtaactcactaga

SEQ ID NO: 30141 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
gcatttgtttgtgtgtgaaa

SEQ ID NO: 30142 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tttaaagactatcctaatgc

SEQ ID NO: 30143 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
tgtacccctgaacctaaaat

SEQ ID NO: 30144 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
gtacaacaaacccccatggc

SEQ ID NO: 30145 - DNA, 20 bp, Artificial Sequence
  Description of Artificial Sequence: Synthetic oligonucleotide
  Target: ATXN1; (-) strand; PAM type: NNNNGHTT; PAM sequence: CTAGGCTT
gaaaaaacaattattgggta

SEQ ID NO: 30146 - DNA, 20 bp, Artificial Sequence
  Description of Artificial Sequence: Synthetic oligonucleotide
  Target: ATXN1; (-) strand; PAM type: NNNNGHTT; PAM sequence: GACAGATT
caacctaaatgcccatcaat

SEQ ID NO: 30147 - DNA, 20 bp, Artificial Sequence
  Description of Artificial Sequence: Synthetic oligonucleotide
  Target: ATXN1; (-) strand; PAM type: NNNNGHTT; PAM sequence: CCGAGATT
gaggcgaaggttgcagtgag

SEQ ID NO: 30148 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
gcgggaggctgaggcaggag

SEQ ID NO: 30149 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
cacttcagcctcccaaagtg

SEQ ID NO: 30150 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtatttttagtagaga

SEQ ID NO: 30151 - DNA, 20 bp, Artificial Sequence
  Description of Artificial Sequence: Synthetic oligonucleotide
  Target: ATXN1; (-) strand; PAM type: NNNNGHTT; PAM sequence: GCTAGTTT
ggcgcacaccaccacgtcca

SEQ ID NO: 30152 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaagtag

SEQ ID NO: 30153 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctctgcctcctgggttc

SEQ ID NO: 30154 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tttttttttttgagatggag

SEQ ID NO: 30155 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
gaatttttttttttttgaga

SEQ ID NO: 30156 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
ttgtgattctgcccgtacag

SEQ ID NO: 30157 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
tcctcagacccattctagct

SEQ ID NO: 30158 - DNA, 20 bp, Artificial Sequence
  Description of Artificial Sequence: Synthetic oligonucleotide
  Target: ATXN1; (-) strand; PAM type: NNNNGHTT; PAM sequence: TCTAGCTT
ggaggagtcctcagacccat

SEQ ID NO: 30159 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
tgagggcagatacaggtttt

SEQ ID NO: 30160 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
gactccccttgagggcagat

SEQ ID NO: 30161 - DNA, 20 bp, Artificial Sequence
  Description of Artificial Sequence: Synthetic oligonucleotide
  Target: ATXN1; (-) strand; PAM type: NNNNGHTT; PAM sequence: GTTAGCTT
gcattggagtggtcacttct

SEQ ID NO: 30162 - DNA, 20 bp, Artificial Sequence
  Description of Artificial Sequence: Synthetic oligonucleotide
  Target: ATXN1; (-) strand; PAM type: NNNNGHTT; PAM sequence: TGCCGATT
ttgttgcttattttctcaga

SEQ ID NO: 30163 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
tggtgtttgggaggtaaggt

SEQ ID NO: 30164 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
ataatgcattgctttaatgt

SEQ ID NO: 30165 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
gaacctccattttaataatg

SEQ ID NO: 30166 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
attctaatgtttatgattgc

SEQ ID NO: 30167 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
tttgctgcatattctaatgt

SEQ ID NO: 30168 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
tatctctttgctgcatattc

SEQ ID NO: 30169 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
ttagaatcattctctctgtg

SEQ ID NO: 30170 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
cttatcatgattataaaaac

SEQ ID NO: 30171 - DNA, 20 bp, Artificial Sequence
  Description of Artificial Sequence: Synthetic oligonucleotide
  Target: ATXN1; (-) strand; PAM type: NNNNGHTT; PAM sequence: TCATGATT
agcataggtgatccttctta

SEQ ID NO: 30172 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
ttgacctaagcctctgtttt

SEQ ID NO: 30173 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
ctgggaaagttgacctaagc

SEQ ID NO: 30174 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
aagccacagagtttgagcca

SEQ ID NO: 30175 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
acattatattcatgaagcca

SEQ ID NO: 30176 - DNA, 20 bp, Artificial Sequence
  Description of Artificial Sequence: Synthetic oligonucleotide
  Target: ATXN1; (-) strand; PAM type: NNNNGHTT; PAM sequence: GCGAGATT
tcagtgagtgaaagcagata

SEQ ID NO: 30177 - DNA, 20 bp, Artificial Sequence
  Description of Artificial Sequence: Synthetic oligonucleotide
  Target: ATXN1; (-) strand; PAM type: NNNNGHTT; PAM sequence: TAGTGCTT
ctgtgacacctgtgtgattt

SEQ ID NO: 30178 - DNA, 20 bp, Artificial Sequence
  Description of Artificial Sequence: Synthetic oligonucleotide
  Target: ATXN1; (-) strand; PAM type: NNNNGHTT; PAM sequence: GTGTGATT
aatttttggctgtgacacct

SEQ ID NO: 30179 - DNA, 20 bp, Artificial Sequence
  Description of Artificial Sequence: Synthetic oligonucleotide
  Target: ATXN1; (-) strand; PAM type: NNNNGHTT; PAM sequence: GTCAGCTT
ttgggactgatgggggacaa

SEQ ID NO: 30180 - DNA, 20 bp, Artificial Sequence
  Description of Artificial Sequence: Synthetic oligonucleotide
  Target: ATXN1; (-) strand; PAM type: NNNNGHTT; PAM sequence: CCCTGCTT
atcaccttgggatttcagaa

SEQ ID NO: 30181 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
atgggagttttgcaatcacc

SEQ ID NO: 30182 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
tgaagatttgtggctgagat

SEQ ID NO: 30183 - DNA, 20 bp, Artificial Sequence
  Description of Artificial Sequence: Synthetic oligonucleotide
  Target: ATXN1; (-) strand; PAM type: NNNNGHTT; PAM sequence: TGAAGATT
ttattgattagccattctaa

SEQ ID NO: 30184 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
gggatctgaaacaaaactct

SEQ ID NO: 30185 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
ttcctctttcctgttgatgc

SEQ ID NO: 30186 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
cttctcttcctctttcctgt

SEQ ID NO: 30187 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
atgccctattttcgagcact

SEQ ID NO: 30188 - DNA, 20 bp, Artificial Sequence
  Description of Artificial Sequence: Synthetic oligonucleotide
  Target: ATXN1; (-) strand; PAM type: NNNNGHTT; PAM sequence: CATGGATT
atagctacgatgcagtggag

SEQ ID NO: 30189 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
catgaagtaagcattattgc

SEQ ID NO: 30190 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
ctaccccatgaagtaagcat

SEQ ID NO: 30191 - DNA, 20 bp, Artificial Sequence
  Description of Artificial Sequence: Synthetic oligonucleotide
  Target: ATXN1; (-) strand; PAM type: NNNNGHTT; PAM sequence: AGGGGATT
gaacatggtgccagtggctg

SEQ ID NO: 30192 - DNA, 20 bp, Artificial Sequence
  Description of Artificial Sequence: Synthetic oligonucleotide
  Target: ATXN1; (-) strand; PAM type: NNNNGHTT; PAM sequence: GGCTGATT
ggtcccctttagggtgacaa

SEQ ID NO: 30193 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
aactttggagagcaaagatt

SEQ ID NO: 30194 - DNA, 20 bp, Artificial Sequence
  Description of Artificial Sequence: Synthetic oligonucleotide
  Target: ATXN1; (-) strand; PAM type: NNNNGHTT; PAM sequence: CAAAGATT
caaatcaaaactttggagag

SEQ ID NO: 30195 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
gcatggccccctcggggctt

SEQ ID NO: 30196 - DNA, 20 bp, Artificial Sequence
  Description of Artificial Sequence: Synthetic oligonucleotide
  Target: ATXN1; (-) strand; PAM type: NNNNGHTT; PAM sequence: CGGGGCTT
tgctggtggcatggccccct

SEQ ID NO: 30197 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
cccccaaccccgcatcccag

SEQ ID NO: 30198 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
ttttttttcttaacccccct

SEQ ID NO: 30199 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
catgtttgtggcatggtaat

SEQ ID NO: 30200 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
tttctaggttctgtagaggt

SEQ ID NO: 30201 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgtctcagcctcccaagtag

SEQ ID NO: 30202 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctccacctcccaggttc

SEQ ID NO: 30203 - DNA, 20 bp, Artificial Sequence
  Description of Artificial Sequence: Synthetic oligonucleotide
  Target: ATXN1; (-) strand; PAM type: NNNNGHTT; PAM sequence: CGGAGTTT
tcttttttttttttttgagg

SEQ ID NO: 30204 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
tctattttccactttcaaaa

SEQ ID NO: 30205 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
acaatgcgtagcaaatgtat

SEQ ID NO: 30206 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
ggtgaaacatgcctcctttt

SEQ ID NO: 30207 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
ttataatcttccttgttttg

SEQ ID NO: 30208 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
attaccttgtttataatctt

SEQ ID NO: 30209 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
attaaataattaattaatta

SEQ ID NO: 30210 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
tctaggcttgtcaatgggtg

SEQ ID NO: 30211 - DNA, 20 bp, Artificial Sequence
  Description of Artificial Sequence: Synthetic oligonucleotide
  Target: ATXN1; (-) strand; PAM type: NNNNGHTT; PAM sequence: CTAGGCTT
acattgggtggcattttttt

SEQ ID NO: 30212 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
cgtgtggtcatgtttgtttc

SEQ ID NO: 30213 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
catatgggtcgtgtggtcat

SEQ ID NO: 30214 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
gactcatatgggtcgtgtgg

SEQ ID NO: 30215 - DNA, 20 bp, Artificial Sequence
  Description of Artificial Sequence: Synthetic oligonucleotide
  Target: ATXN1; (-) strand; PAM type: NNNNGHTT; PAM sequence: GGGTGCTT
ttgggaggacctggaattgt

SEQ ID NO: 30216 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
gcagatagtaggcattggtt

SEQ ID NO: 30217 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
ttgccttgagctgtcactat

SEQ ID NO: 30218 - DNA, 20 bp, Artificial Sequence
  Description of Artificial Sequence: Synthetic oligonucleotide
  Target: ATXN1; (-) strand; PAM type: NNNNGHTT; PAM sequence: ATGAGCTT
gactgtctttaccgaatgac

SEQ ID NO: 30219 - DNA, 20 bp, Artificial Sequence
  Description of Artificial Sequence: Synthetic oligonucleotide
  Target: ATXN1; (-) strand; PAM type: NNNNGHTT; PAM sequence: GCGGGCTT
gttatattgttagctgtagt

SEQ ID NO: 30220 - DNA, 20 bp, Artificial Sequence
  Description of Artificial Sequence: Synthetic oligonucleotide
  Target: ATXN1; (-) strand; PAM type: NNNNGHTT; PAM sequence: ATAGGTTT
atcaagaaaccagacatcta

SEQ ID NO: 30221 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
gggcatttcaagctggagat

SEQ ID NO: 30222 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
tgttttctaagaagaaagag

SEQ ID NO: 30223 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
aagggaggaagtggtttaaa

SEQ ID NO: 30224 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
ttagatggattaagggagga

SEQ ID NO: 30225 - DNA, 20 bp, Artificial Sequence
  Description of Artificial Sequence: Synthetic oligonucleotide
  Target: ATXN1; (-) strand; PAM type: NNNNGHTT; PAM sequence: GATGGATT
aactagatggggttagttta

SEQ ID NO: 30226 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
ggatgccagaactagatggg

SEQ ID NO: 30227 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
tgctaagtaaatgctaaatc

SEQ ID NO: 30228 - DNA, 20 bp, Artificial Sequence
  Description of Artificial Sequence: Synthetic oligonucleotide
  Target: ATXN1; (-) strand; PAM type: NNNNGHTT; PAM sequence: TAGTGCTT
cattacagagaaatccatgg

SEQ ID NO: 30229 - DNA, 20 bp, Artificial Sequence
  Description of Artificial Sequence: Synthetic oligonucleotide
  Target: ATXN1; (-) strand; PAM type: NNNNGHTT; PAM sequence: GTAGGATT
agattacatataaggcatat

SEQ ID NO: 30230 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
cagaaaagaggagaacctgc

SEQ ID NO: 30231 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
aaagctgtttttttaaaaat

SEQ ID NO: 30232 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
tgtaaattaaatcttaataa

SEQ ID NO: 30233 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
atctaaaattagattgtgat

SEQ ID NO: 30234 - DNA, 20 bp, Artificial Sequence
  Description of Artificial Sequence: Synthetic oligonucleotide
  Target: ATXN1; (-) strand; PAM type: NNNNGHTT; PAM sequence: ATTAGATT
tttggagaagaaaatctaaa

SEQ ID NO: 30235 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
agagtgactgctaatgtaca

SEQ ID NO: 30236 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
acaaatccatagagacagaa

SEQ ID NO: 30237 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
cacacacacacacgcaaaat

SEQ ID NO: 30238 - DNA, 20 bp, Artificial Sequence
  Description of Artificial Sequence: Synthetic oligonucleotide
  Target: ATXN1; (-) strand; PAM type: NNNNGHTT; PAM sequence: TAGAGCTT
ggggttgggaacccctgctc

SEQ ID NO: 30239 - DNA, 20 bp, Artificial Sequence
  Description of Artificial Sequence: Synthetic oligonucleotide
  Target: ATXN1; (-) strand; PAM type: NNNNGHTT; PAM sequence: TGAAGCTT
ggagtggctgtaaatacaga

SEQ ID NO: 30240 - DNA, 20 bp, Artificial Sequence
  Description of Artificial Sequence: Synthetic oligonucleotide
  Target: ATXN1; (-) strand; PAM type: NNNNGHTT; PAM sequence: ATTAGATT
acagtgacagatcatcaggc

SEQ ID NO: 30241 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
agaatcagtgagatccttga

SEQ ID NO: 30242 - DNA, 20 bp, Artificial Sequence
  Description of Artificial Sequence: Synthetic oligonucleotide
  Target: ATXN1; (-) strand; PAM type: NNNNGHTT; PAM sequence: TTGAGCTT
atgtagaatcagtgagatcc

SEQ ID NO: 30243 - DNA, 20 bp, Artificial Sequence
  Description of Artificial Sequence: Synthetic oligonucleotide
  Target: ATXN1; (-) strand; PAM type: NNNNGHTT; PAM sequence: GGATGATT
tggagcgggggatggttttg

SEQ ID NO: 30244 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
cagactagggtggagcgggg

SEQ ID NO: 30245 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
cagggactggtttcatggaa

SEQ ID NO: 30246 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
taacctttttggcaccaggg

SEQ ID NO: 30247 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
cgttgaacttctgtcacatc

SEQ ID NO: 30248 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
cccttgtcaggttgctactt

SEQ ID NO: 30249 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
ttgtaagcggcagcagcagt

SEQ ID NO: 30250 - DNA, 20 bp, Artificial Sequence
  Description of Artificial Sequence: Synthetic oligonucleotide
  Target: ATXN1; (-) strand; PAM type: NNNNGHTT; PAM sequence: ATGAGCTT
gcctgaactcacacatatga

SEQ ID NO: 30251 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
cctaaagaatcagataacga

SEQ ID NO: 30252 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
cccttttgaaattatttctc

SEQ ID NO: 30253 - DNA, 20 bp, Artificial Sequence
  Description of Artificial Sequence: Synthetic oligonucleotide
  Target: ATXN1; (-) strand; PAM type: NNNNGHTT; PAM sequence: AGTGGATT
ttttggatgcttctggctac

SEQ ID NO: 30254 - DNA, 20 bp, Artificial Sequence
  Description of Artificial Sequence: Synthetic oligonucleotide
  Target: ATXN1; (-) strand; PAM type: NNNNGHTT; PAM sequence: GGATGCTT
catgttttcaggatgctttt

SEQ ID NO: 30255 - DNA, 20 bp, Artificial Sequence
  Description of Artificial Sequence: Synthetic oligonucleotide
  Target: ATXN1; (-) strand; PAM type: NNNNGHTT; PAM sequence: GGATGCTT
ttcctccactcatgttttca

SEQ ID NO: 30256 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
cctgctcagccttcctccac

SEQ ID NO: 30257 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
gcacagtgggcgtcgtcgct

SEQ ID NO: 30258 - DNA, 20 bp, Artificial Sequence
  Description of Artificial Sequence: Synthetic oligonucleotide
  Target: ATXN1; (-) strand; PAM type: NNNNGHTT; PAM sequence: CGTCGCTT
ttccccagcacagtgggcgt

SEQ ID NO: 30259 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
ccttgcacggactgtgctgc

SEQ ID NO: 30260 - DNA, 20 bp, Artificial Sequence
  Description of Artificial Sequence: Synthetic oligonucleotide
  Target: ATXN1; (-) strand; PAM type: NNNNGHTT; PAM sequence: CCGCGTTT
tgaaaacaccttgtagggag

SEQ ID NO: 30261 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
gttaccaacctctctggaat

SEQ ID NO: 30262 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
gaggagagtggtcacacaat

SEQ ID NO: 30263 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
tgaggtccagttggaaacta

SEQ ID NO: 30264 - DNA, 20 bp, Artificial Sequence
  Description of Artificial Sequence: Synthetic oligonucleotide
  Target: ATXN1; (-) strand; PAM type: NNNNGHTT; PAM sequence: GCTTGCTT
catgagggcctgtcccagtg

SEQ ID NO: 30265 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
aagacatgagggcctgtccc

SEQ ID NO: 30266 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
atcaaatatttgtctgtata

SEQ ID NO: 30267 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
aggtgtaaaagctaatttag

SEQ ID NO: 30268 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
tcgttaggtgtaaaagctaa

SEQ ID NO: 30269 - DNA, 20 bp, Artificial Sequence
  Description of Artificial Sequence: Synthetic oligonucleotide
  Target: ATXN1; (-) strand; PAM type: NNNNGHTT; PAM sequence: ACTAGTTT
ctgtcttccacaatggttga

SEQ ID NO: 30270 - DNA, 20 bp, Artificial Sequence
  Description of Artificial Sequence: Synthetic oligonucleotide
  Target: ATXN1; (-) strand; PAM type: NNNNGHTT; PAM sequence: GCATGATT
gcgcatgtgcctttatagca

SEQ ID NO: 30271 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
atttgctgagaatgatggtt

SEQ ID NO: 30272 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
tgcgataatttgctgagaat

SEQ ID NO: 30273 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
atgagtgagaacatgcggtg

SEQ ID NO: 30274 - DNA, 20 bp, Artificial Sequence
  Description of Artificial Sequence: Synthetic oligonucleotide
  Target: ATXN1; (-) strand; PAM type: NNNNGHTT; PAM sequence: CGGTGTTT
cacctatgagtgagaacatg

SEQ ID NO: 30275 - DNA, 20 bp, Artificial Sequence
  Description of Artificial Sequence: Synthetic oligonucleotide
  Target: ATXN1; (-) strand; PAM type: NNNNGHTT; PAM sequence: TAAAGCTT
tttacattaggtatatctcc

SEQ ID NO: 30276 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
agggtacatgtgcacaatgt

SEQ ID NO: 30277 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
gttgacttctagtgtgctca

SEQ ID NO: 30278 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
aactcgacatggatatttta

SEQ ID NO: 30279 - DNA, 20 bp, Artificial Sequence
  Description of Artificial Sequence: Synthetic oligonucleotide
  Target: ATXN1; (-) strand; PAM type: NNNNGHTT; PAM sequence: TATAGCTT
tgtttagcagaactgaacta

SEQ ID NO: 30280 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
gtagtatatcagagtttttt

SEQ ID NO: 30281 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
ctggcgtagctgtagtatat

SEQ ID NO: 30282 - DNA, 20 bp, Artificial Sequence
  Description of Artificial Sequence: Synthetic oligonucleotide
  Target: ATXN1; (-) strand; PAM type: NNNNGHTT; PAM sequence: TTGCGATT
gggaatcgccccccaacaac

SEQ ID NO: 30283 - DNA, 20 bp, Artificial Sequence
  Description of Artificial Sequence: Synthetic oligonucleotide
  Target: ATXN1; (-) strand; PAM type: NNNNGHTT; PAM sequence: TCGTGATT
cccaaactgatgagtcacaa

SEQ ID NO: 30284 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
acatttggcagataataata

SEQ ID NO: 30285 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
gggctatgcctacctctgcc

SEQ ID NO: 30286 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
ggatccacccctgattatga

SEQ ID NO: 30287 - DNA, 20 bp, Artificial Sequence
  Description of Artificial Sequence: Synthetic oligonucleotide
  Target: ATXN1; (-) strand; PAM type: NNNNGHTT; PAM sequence: CCCTGATT
acctcacagactggatccac

SEQ ID NO: 30288 - DNA, 20 bp, Artificial Sequence
  Description of Artificial Sequence: Synthetic oligonucleotide
  Target: ATXN1; (-) strand; PAM type: NNNNGHTT; PAM sequence: ACTAGTTT
acacactcctctaccccttg

SEQ ID NO: 30289 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cacttcagcctcccaaagtt

SEQ ID NO: 30290 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
atgggggtctcactatgttg

SEQ ID NO: 30291 - DNA, 20 bp, Artificial Sequence
  Description of Artificial Sequence: Synthetic oligonucleotide
  Target: ATXN1; (-) strand; PAM type: NNNNGHTT; PAM sequence: GCTGGATT
cgtctagctctgtcatccag

SEQ ID NO: 30292 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
attttatgttgataattttg

SEQ ID NO: 30293 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
tgtgcatgcattgtgggcca

SEQ ID NO: 30294 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
ctcagcaaaaatgtatacta

SEQ ID NO: 30295 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
ctgataaatgactgtgggat

SEQ ID NO: 30296 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
acttgcttaggaacctgcag

SEQ ID NO: 30297 - DNA, 20 bp, Artificial Sequence
  Description of Artificial Sequence: Synthetic oligonucleotide
  Target: ATXN1; (-) strand; PAM type: NNNNGHTT; PAM sequence: ACTTGCTT
ctatgatattaatctgggct

SEQ ID NO: 30298 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
cactcgacccaagaagtcca

SEQ ID NO: 30299 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
tagctacagagcgctgattg

SEQ ID NO: 30300 - DNA, 20 bp, Artificial Sequence
  Description of Artificial Sequence: Synthetic oligonucleotide
  Target: ATXN1; (-) strand; PAM type: NNNNGHTT; PAM sequence: CGCTGATT
acctcaagctagctacagag

SEQ ID NO: 30301 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
gattggtccattttacagag

SEQ ID NO: 30302 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
gattggtccattctacagag

SEQ ID NO: 30303 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
atttgtccctgcccatgtcc

SEQ ID NO: 30304 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
tgtctctgctggctggcgtg

SEQ ID NO: 30305 - DNA, 20 bp, Artificial Sequence
  Description of Artificial Sequence: Synthetic oligonucleotide
  Target: ATXN1; (-) strand; PAM type: NNNNGHTT; PAM sequence: GCAAGATT
gacccaaagagcgagcagta

SEQ ID NO: 30306 - DNA, 20 bp, Artificial Sequence
  Description of Artificial Sequence: Synthetic oligonucleotide
  Target: ATXN1; (-) strand; PAM type: NNNNGHTT; PAM sequence: ATAGGTTT
tctggagttggttccttccg

SEQ ID NO: 30307 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
ttaggcggctgaggcaggag

SEQ ID NO: 30308 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
gtcagagtgaatgtgttatt

SEQ ID NO: 30309 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
tggagaggtgatgctggtgg

SEQ ID NO: 30310 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
cataacagatataacagcgc

SEQ ID NO: 30311 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
gtcagaacacacatgacatt

SEQ ID NO: 30312 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
caccttggcctcccaaagtg

SEQ ID NO: 30313 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
ttttgtatttttagtagaga

SEQ ID NO: 30314 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
ctaactttttgtatttttag

SEQ ID NO: 30315 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
cttgagtgcagtggcacgat

SEQ ID NO: 30316 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
acagagtctcgctctgtcac

SEQ ID NO: 30317 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
actcactcttcctttcactt

SEQ ID NO: 30318 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
cctcgctaagcttaatcatt

SEQ ID NO: 30319 - DNA, 20 bp, Artificial Sequence
  Description of Artificial Sequence: Synthetic oligonucleotide
  Target: ATXN1; (-) strand; PAM type: NNNNGHTT; PAM sequence: CTAAGCTT
ctttcaacatgccttcctcg

SEQ ID NO: 30320 - DNA, 20 bp, Artificial Sequence
  Description of Artificial Sequence: Synthetic oligonucleotide
  Target: ATXN1; (-) strand; PAM type: NNNNGHTT; PAM sequence: GTCAGCTT
aagcctggcttttgacatat

SEQ ID NO: 30321 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
aacccttcagtcacaagaag

SEQ ID NO: 30322 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
aagaacttttccttagcatt

SEQ ID NO: 30323 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
tttgtccatatcagcaacaa

SEQ ID NO: 30324 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
cttaagggaatgtatggctg

SEQ ID NO: 30325 - DNA, 20 bp, Artificial Sequence
  Description of Artificial Sequence: Synthetic oligonucleotide
  Target: ATXN1; (-) strand; PAM type: NNNNGHTT; PAM sequence: GCTGGTTT
ttggcttaagggaatgtatg

SEQ ID NO: 30326 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
ggccttgatctggattaggc

SEQ ID NO: 30327 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
agttagggccttgatctgga

SEQ ID NO: 30328 - DNA, 20 bp, Artificial Sequence
  Description of Artificial Sequence: Synthetic oligonucleotide
  Target: ATXN1; (-) strand; PAM type: NNNNGHTT; PAM sequence: TCTGGATT
gaagagagttagggccttga

SEQ ID NO: 30329 - DNA, 20 bp, Artificial Sequence
  Description of Artificial Sequence: Synthetic oligonucleotide
  Target: ATXN1; (-) strand; PAM type: NNNNGHTT; PAM sequence: GCTAGCTT
aatctcacgaaccaacttct

SEQ ID NO: 30330 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
gcttctacatcagcatttgg

SEQ ID NO: 30331 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
aaattttctggataacctgc

SEQ ID NO: 30332 - DNA, 20 bp, Artificial Sequence
  Description of Artificial Sequence: Synthetic oligonucleotide
  Target: ATXN1; (-) strand; PAM type: NNNNGHTT; PAM sequence: GGCTGCTT
ggcattttcttccaatagaa

SEQ ID NO: 30333 - DNA, 20 bp, Artificial Sequence
  Description of Artificial Sequence: Synthetic oligonucleotide
  Target: ATXN1; (-) strand; PAM type: NNNNGHTT; PAM sequence: TGAAGCTT
aagagagtcagcctctcctt

SEQ ID NO: 30334 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
ttttggaatggtaaatgagc

SEQ ID NO: 30335 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
tcagcataattattagggct

SEQ ID NO: 30336 - DNA, 20 bp, Artificial Sequence
  Description of Artificial Sequence: Synthetic oligonucleotide
  Target: ATXN1; (-) strand; PAM type: NNNNGHTT; PAM sequence: AGTAGATT
catttctatagcactggcag

SEQ ID NO: 30337 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
gtaacccaatgtgctttcat

SEQ ID NO: 30338 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
ttaaagtatttagtaaccca

SEQ ID NO: 30339 - DNA, 20 bp, Artificial Sequence
  Description of Artificial Sequence: Synthetic oligonucleotide
  Target: ATXN1; (-) strand; PAM type: NNNNGHTT; PAM sequence: GTGGGCTT
tgagcaattaagtctcaaca

SEQ ID NO: 30340 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
acaatggtgaatcctttcca

SEQ ID NO: 30341 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
atttctaattctggttctct

SEQ ID NO: 30342 - DNA, 20 bp, Artificial Sequence
  Description of Artificial Sequence: Synthetic oligonucleotide
  Target: ATXN1; (-) strand; PAM type: NNNNGHTT; PAM sequence: ATGAGATT
tcatctgctgaagtttgatc

SEQ ID NO: 30343 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
agaggcaactcctcatctgc

SEQ ID NO: 30344 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tgcctcggcctcccaaagtg

SEQ ID NO: 30345 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
atggcctctatctccggacc

SEQ ID NO: 30346 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
tttttgtatttttagtagag

SEQ ID NO: 30347 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gtttttttgtttgtttgttt

SEQ ID NO: 30348 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
actggtttttttgtttgttt

SEQ ID NO: 30349 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
aaccactggtttttttgttt

SEQ ID NO: 30350 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
atgaaaccactggttttttt

SEQ ID NO: 30351 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tctcatgaaaccactggttt

SEQ ID NO: 30352 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
agattacatctcatgaaacc

SEQ ID NO: 30353 - DNA, 20 bp, Artificial Sequence
  Description of Artificial Sequence: Synthetic oligonucleotide
  Target: ATXN1; (-) strand; PAM type: NNNNGHTT; PAM sequence: AGTAGATT
ttcacagtatcttcatcagg

SEQ ID NO: 30354 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
caaacctgtcactgcatcaa

SEQ ID NO: 30355 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
gatttctctgtagtatgcac

SEQ ID NO: 30356 - DNA, 20 bp, Artificial Sequence
  Description of Artificial Sequence: Synthetic oligonucleotide
  Target: ATXN1; (-) strand; PAM type: NNNNGHTT; PAM sequence: GAAAGATT
ttattgactcttcctttcat

SEQ ID NO: 30357 - DNA, 20 bp, Artificial Sequence
  Description of Artificial Sequence: Synthetic oligonucleotide
  Target: ATXN1; (-) strand; PAM type: NNNNGHTT; PAM sequence: TGACGTTT
ttcttaaaattagacaacaa

SEQ ID NO: 30358 - DNA, 20 bp, Artificial Sequence
  Description of Artificial Sequence: Synthetic oligonucleotide
  Target: ATXN1; (-) strand; PAM type: NNNNGHTT; PAM sequence: GACTGATT
tctttacgttgatggctgct

SEQ ID NO: 30359 - DNA, 20 bp, Artificial Sequence
  Description of Artificial Sequence: Synthetic oligonucleotide
  Target: ATXN1; (-) strand; PAM type: NNNNGHTT; PAM sequence: AATCGTTT
gatcatcttcattgaaccat

SEQ ID NO: 30360 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
aagtacataccttaatttta

SEQ ID NO: 30361 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
ggttttccagtgcatataag

SEQ ID NO: 30362 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
acagcaaatcacacaaattt

SEQ ID NO: 30363 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cacctcagcctcccaaagtg

SEQ ID NO: 30364 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttagtagaga

SEQ ID NO: 30365 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
ttttttttttgagttgggag

SEQ ID NO: 30366 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
gcgtgagccaccgcagctgg

SEQ ID NO: 30367 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
acgaggtttcatcatgttgc

SEQ ID NO: 30368 - DNA, 20 bp, Artificial Sequence
  Description of Artificial Sequence: Synthetic oligonucleotide
  Target: ATXN1; (-) strand; PAM type: NNNNGHTT; PAM sequence: CGAGGTTT
ttttgtattttttgtagaga

SEQ ID NO: 30369 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tgcctcagcctcccaagtag

SEQ ID NO: 30370 - DNA, 20 bp, Artificial Sequence
  Description of Artificial Sequence: Synthetic oligonucleotide
  Target: ATXN1; (-) strand; PAM type: NNNNGHTT; PAM sequence: AGTTGATT
agtttcatgtgcctctttgg

SEQ ID NO: 30371 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
cgatcgaactctttctgaga

SEQ ID NO: 30372 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
gaatatgggcatagagaaga

SEQ ID NO: 30373 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
cataatttaatttttaataa

SEQ ID NO: 30374 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
tattgtacactgtgtctcta

SEQ ID NO: 30375 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
gcgtgagccaccacacctgg

SEQ ID NO: 30376 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttagtagaga

SEQ ID NO: 30377 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
ctactctgaaagtgtcctta

SEQ ID NO: 30378 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
ccatgctagtgctgattttc

SEQ ID NO: 30379 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
atatttggcatccatgctag

SEQ ID NO: 30380 - DNA, 20 bp, Artificial Sequence
  Description of Artificial Sequence: Synthetic oligonucleotide
  Target: ATXN1; (-) strand; PAM type: NNNNGHTT; PAM sequence: GTCTGCTT
aagagtctcaaaaatatcaa

SEQ ID NO: 30381 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
aatctgtatttattagcttg

SEQ ID NO: 30382 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
tttggcccaaatctgtattt

SEQ ID NO: 30383 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
atggcaacaggcaatgcagt

SEQ ID NO: 30384 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
acacatggcaacaggcaatg

SEQ ID NO: 30385 - DNA, 20 bp, Artificial Sequence
  Description of Artificial Sequence: Synthetic oligonucleotide
  Target: ATXN1; (-) strand; PAM type: NNNNGHTT; PAM sequence: CCACGTTT
cttcttccatctggtggaac

SEQ ID NO: 30386 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
ctagatatttggggcaagca

SEQ ID NO: 30387 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
aactaactcttcacagtaga

SEQ ID NO: 30388 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
ctttgcagaggttaaatgga

SEQ ID NO: 30389 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
acgttgctaagcaagtacac

SEQ ID NO: 30390 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
ctccactaagtatttcttcc

SEQ ID NO: 30391 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
ctattgaacctctcttttat

SEQ ID NO: 30392 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
gctgcttggagatggtaaag

SEQ ID NO: 30393 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
actgggactgaagaaagtaa

SEQ ID NO: 30394 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
agcaactcctttttgcctgt

SEQ ID NO: 30395 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
tccttaacaaaactctggaa

SEQ ID NO: 30396 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
atactggtggagtctgtttt

SEQ ID NO: 30397 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
actccataaatactggtgga

SEQ ID NO: 30398 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgctttggcctctcagagtg

SEQ ID NO: 30399 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
gccctgtgttccagcaattc

SEQ ID NO: 30400 - DNA, 20 bp, Artificial Sequence
  Description of Artificial Sequence: Synthetic oligonucleotide
  Target: ATXN1; (-) strand; PAM type: NNNNGHTT; PAM sequence: GATGGATT
tttaattttttttttgtaga

SEQ ID NO: 30401 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
agtggtagacacgtcttttg

SEQ ID NO: 30402 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cctggagtggtagacacgtc

SEQ ID NO: 30403 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
ctcttagcaggaatttactt

SEQ ID NO: 30404 - DNA, 20 bp, Artificial Sequence
  Description of Artificial Sequence: Synthetic oligonucleotide
  Target: ATXN1; (-) strand; PAM type: NNNNGHTT; PAM sequence: ATGGGATT
cacattttacagatgagaaa

SEQ ID NO: 30405 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
tggggctttacataaattag

SEQ ID NO: 30406 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
catatatcagattctgtggt

SEQ ID NO: 30407 - DNA, 20 bp, Artificial Sequence
  Description of Artificial Sequence: Synthetic oligonucleotide
  Target: ATXN1; (-) strand; PAM type: NNNNGHTT; PAM sequence: ATCAGATT
ttcactgagtggtgccatat

SEQ ID NO: 30408 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
gggagactgggaggaagata

SEQ ID NO: 30409 - DNA, 20 bp, Artificial Sequence
  Description of Artificial Sequence: Synthetic oligonucleotide
  Target: ATXN1; (-) strand; PAM type: NNNNGHTT; PAM sequence: ACCAGTTT
atatttgaggaaagctgtgg

SEQ ID NO: 30410 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
gagctgacttggaagaatgg

SEQ ID NO: 30411 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
acaaaggagtgggatattta

SEQ ID NO: 30412 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
tcttcatgccttcctacaaa

SEQ ID NO: 30413 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
agtttgtggtaaaatttttc

SEQ ID NO: 30414 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
tcatggaatttcgttagtta

SEQ ID NO: 30415 - DNA, 20 bp, Artificial Sequence
  Description of Artificial Sequence: Synthetic oligonucleotide
  Target: ATXN1; (-) strand; PAM type: NNNNGHTT; PAM sequence: TAAAGCTT
taaatgagtcttgatgcacg

SEQ ID NO: 30416 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
ttgggcgtctgagacaggag

SEQ ID NO: 30417 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
gtgacttaatctctttgggt

SEQ ID NO: 30418 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
aggttcttgaggcaaacttc

SEQ ID NO: 30419 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
gacaactgattacagccacc

SEQ ID NO: 30420 - DNA, 20 bp, Artificial Sequence
  Description of Artificial Sequence: Synthetic oligonucleotide
  Target: ATXN1; (-) strand; PAM type: NNNNGHTT; PAM sequence: AACTGATT
ttaaaatctagccctgagac

SEQ ID NO: 30421 - DNA, 20 bp, Artificial Sequence
  Description of Artificial Sequence: Synthetic oligonucleotide
  Target: ATXN1; (-) strand; PAM type: NNNNGHTT; PAM sequence: CAAAGATT
tatattcaatccccagatct

SEQ ID NO: 30422 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
ttcttgcatggtgagaacat

SEQ ID NO: 30423 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
tgatatacatatatattgtg

SEQ ID NO: 30424 - DNA, 20 bp, Artificial Sequence
  Description of Artificial Sequence: Synthetic oligonucleotide
  Target: ATXN1; (-) strand; PAM type: NNNNGHTT; PAM sequence: CGATGCTT
gacaaaatttgtgtacaaca

SEQ ID NO: 30425 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
atttttccagcattattgag

SEQ ID NO: 30426 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgtctcagcctcccaaagtg

SEQ ID NO: 30427 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaagtag

SEQ ID NO: 30428 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
attttattttgtttttgaga

SEQ ID NO: 30429 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
caaagttttattttatttta

SEQ ID NO: 30430 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
cagagtaccttgatggatcc

SEQ ID NO: 30431 - DNA, 20 bp, Artificial Sequence
  Description of Artificial Sequence: Synthetic oligonucleotide
  Target: ATXN1; (-) strand; PAM type: NNNNGHTT; PAM sequence: AGTAGCTT
aggaagtgtctgtaagcaat

SEQ ID NO: 30432 - DNA, 20 bp, Artificial Sequence
  Description of Artificial Sequence: Synthetic oligonucleotide
  Target: ATXN1; (-) strand; PAM type: NNNNGHTT; PAM sequence: AGGTGCTT
aaggtgcctctcaatatagt

SEQ ID NO: 30433 - DNA, 20 bp, Artificial Sequence
  Description of Artificial Sequence: Synthetic oligonucleotide
  Target: ATXN1; (-) strand; PAM type: NNNNGHTT; PAM sequence: TGACGCTT
tcaggaaggcaattagacta

SEQ ID NO: 30434 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
ctaaggtgaatgtgcagact

SEQ ID NO: 30435 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
atttaaaaacctgacccttc

SEQ ID NO: 30436 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
tttcatgtaagttgatcctt

SEQ ID NO: 30437 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
actaacatttattgattgac

SEQ ID NO: 30438 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
attagtcagtcactaacatt

SEQ ID NO: 30439 - DNA, 20 bp, Artificial Sequence
  Description of Artificial Sequence: Synthetic oligonucleotide
  Target: ATXN1; (-) strand; PAM type: NNNNGHTT; PAM sequence: ACTGGATT
atgccaaaaggtgaactgtc

SEQ ID NO: 30440 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
ccttgcccagccttcagttt

SEQ ID NO: 30441 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
catgatagccttgcccagcc

SEQ ID NO: 30442 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
ttgtaatggggaatttcagt

SEQ ID NO: 30443 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
aataagttgtaatggggaat

SEQ ID NO: 30444 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
aaaatagagttttttcctat

SEQ ID NO: 30445 - DNA, 20 bp, Artificial Sequence
  Description of Artificial Sequence: Synthetic oligonucleotide
  Target: ATXN1; (-) strand; PAM type: NNNNGHTT; PAM sequence: TAGAGTTT
gtgtatatacatatataaaa

SEQ ID NO: 30446 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
aaataatattttgatatcgg

SEQ ID NO: 30447 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
accaaaagagaaaaaaataa

SEQ ID NO: 30448 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
ttttttttcatttctaagaa

SEQ ID NO: 30449 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
tactaaaaaccattttttta

SEQ ID NO: 30450 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
ctaacatcagatagaattgc

SEQ ID NO: 30451 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
aaaattctaacatcagatag

SEQ ID NO: 30452 - DNA, 20 bp, Artificial Sequence
  Description of Artificial Sequence: Synthetic oligonucleotide
  Target: ATXN1; (-) strand; PAM type: NNNNGHTT; PAM sequence: GTTGGATT
aaacagtttttacagtaata

SEQ ID NO: 30453 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
aaaatagatgtttttggtta

SEQ ID NO: 30454 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
ttcataaaaattacaaaaat

SEQ ID NO: 30455 - DNA, 20 bp, Artificial Sequence
  Description of Artificial Sequence: Synthetic oligonucleotide
  Target: ATXN1; (-) strand; PAM type: NNNNGHTT; PAM sequence: ATAAGCTT
gatattaaaaatgtttttgg

SEQ ID NO: 30456 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
tccttcaggtaagatattaa

SEQ ID NO: 30457 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
aagcccattcctgcatataa

SEQ ID NO: 30458 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
gctcatatagctatcttggt

SEQ ID NO: 30459 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
aagaggatttcttgagccca

SEQ ID NO: 30460 - DNA, 20 bp, Artificial Sequence
  Description of Artificial Sequence: Synthetic oligonucleotide
  Target: ATXN1; (-) strand; PAM type: NNNNGHTT; PAM sequence: AGAGGATT
cattttgagaggctgaggga

SEQ ID NO: 30461 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
aataaccatgcacctgtccc

SEQ ID NO: 30462 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
cttccatctctccatataat

SEQ ID NO: 30463 - DNA, 20 bp, Artificial Sequence
  Description of Artificial Sequence: Synthetic oligonucleotide
  Target: ATXN1; (-) strand; PAM type: NNNNGHTT; PAM sequence: GTTAGCTT
tgaataattgaaaggatttt

SEQ ID NO: 30464 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
tgaagtaaaatgaataattg

SEQ ID NO: 30465 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
ttagggcaattcatgtgtgt

SEQ ID NO: 30466 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
atttcaaaattgtgcaaaca

SEQ ID NO: 30467 - DNA, 20 bp, Artificial Sequence
  Description of Artificial Sequence: Synthetic oligonucleotide
  Target: ATXN1; (-) strand; PAM type: NNNNGHTT; PAM sequence: GGCAGCTT
aaacttaaaatatggaagaa

SEQ ID NO: 30468 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
tggtacaagaataggttaca

SEQ ID NO: 30469 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
gcctgtgattcgccgaaacc

SEQ ID NO: 30470 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
gggtttgaacgataggctgc

SEQ ID NO: 30471 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
cagcgttcgccttatttgaa

SEQ ID NO: 30472 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
tgaggtacagaaacagccag

SEQ ID NO: 30473 - DNA, 20 bp, Artificial Sequence
  Description of Artificial Sequence: Synthetic oligonucleotide
  Target: ATXN1; (-) strand; PAM type: NNNNGHTT; PAM sequence: GCCAGATT
agaagtgaggtacagaaaca

SEQ ID NO: 30474 - DNA, 20 bp, Artificial Sequence
  Description of Artificial Sequence: Synthetic oligonucleotide
  Target: ATXN1; (-) strand; PAM type: NNNNGHTT; PAM sequence: AGAGGATT
acatgctgttgtgtggttgg

SEQ ID NO: 30475 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
ctcctttcctcccgaactag

SEQ ID NO: 30476 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
tttagacaaattaaatttaa

SEQ ID NO: 30477 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
attctcatatgaaagaaagg

SEQ ID NO: 30478 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
gcagtggcttccaagaagcc

SEQ ID NO: 30479 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
tcacttgcctggactgctgc

SEQ ID NO: 30480 - DNA, 20 bp, Artificial Sequence
  Description of Artificial Sequence: Synthetic oligonucleotide
  Target: ATXN1; (-) strand; PAM type: NNNNGHTT; PAM sequence: GATAGTTT
gagtttggcctctttaatat

SEQ ID NO: 30481 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
cgtgagccactgcccccagt

SEQ ID NO: 30482 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
tgcctaagcctcccaaagtg

SEQ ID NO: 30483 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttggtagaga

SEQ ID NO: 30484 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
tgcctcagcctcctgagtag

SEQ ID NO: 30485 - DNA, 20 bp, Artificial Sequence
  Description of Artificial Sequence: Synthetic oligonucleotide
  Target: ATXN1; (-) strand; PAM type: NNNNGHTT; PAM sequence: AGTAGCTT
tctcctgcctcagcctcctg

SEQ ID NO: 30486 - DNA, 20 bp, Artificial Sequence
  Description of Artificial Sequence: Synthetic oligonucleotide
  Target: ATXN1; (-) strand; PAM type: NNNNGHTT; PAM sequence: AAGGGATT
aacctctgcttcccaggttc

SEQ ID NO: 30487 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
ccatctcagcttactgcaac

SEQ ID NO: 30488 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
ctggagtgcagtggcaccat

SEQ ID NO: 30489 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
atgctggacacctcctcttc

SEQ ID NO: 30490 - DNA, 20 bp, Artificial Sequence
  Description of Artificial Sequence: Synthetic oligonucleotide
  Target: ATXN1; (-) strand; PAM type: NNNNGHTT; PAM sequence: CTACGTTT
aacctgactttgtcattgtc

SEQ ID NO: 30491 - DNA, 20 bp, Artificial Sequence
  Description of Artificial Sequence: Synthetic oligonucleotide
  Target: ATXN1; (-) strand; PAM type: NNNNGHTT; PAM sequence: CAATGATT
ttctcttcagagtttaagct

SEQ ID NO: 30492 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
tatttctgtctctttctctt

SEQ ID NO: 30493 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
gacctagagtttgttaccgc

SEQ ID NO: 30494 - DNA, 20 bp, Artificial Sequence
  Description of Artificial Sequence: Synthetic oligonucleotide
  Target: ATXN1; (-) strand; PAM type: NNNNGHTT; PAM sequence: TAGAGTTT
aaaaaggaaaagcagtgacc

SEQ ID NO: 30495 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
cccttctttagtgacaattt

SEQ ID NO: 30496 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
acaggcatcatcaaaacaga

SEQ ID NO: 30497 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
taagtccttcagagaagctg

SEQ ID NO: 30498 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
ttgctgatgctatcacaggc

SEQ ID NO: 30499 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
agaaagctctcgcagtgctt

SEQ ID NO: 30500 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
ccatcgttagaaagctctcg

SEQ ID NO: 30501 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
acagccacctaaatcatagg

SEQ ID NO: 30502 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
gtgaggcatccttgagaggt

SEQ ID NO: 30503 - DNA, 20 bp, Artificial Sequence
  Description of Artificial Sequence: Synthetic oligonucleotide
  Target: ATXN1; (-) strand; PAM type: NNNNGHTT; PAM sequence: TATCGTTT
gttagaaactgtgtcacttg

SEQ ID NO: 30504 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
catggtaggaaaacagaaaa

SEQ ID NO: 30505 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
aaaatgccagatgttggcat

SEQ ID NO: 30506 - DNA, 20 bp, Artificial Sequence
  Description of Artificial Sequence: Synthetic oligonucleotide
  Target: ATXN1; (-) strand; PAM type: NNNNGHTT; PAM sequence: ACAGGATT
tttttaaaaaattatagagt

SEQ ID NO: 30507 - DNA, 20 bp, Artificial Sequence
  Description of Artificial Sequence: Synthetic oligonucleotide
  Target: ATXN1; (-) strand; PAM type: NNNNGHTT; PAM sequence: GCGAGATT
aggtggaggagtaatgaggg

SEQ ID NO: 30508 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
ttccatctgatgggagcgag

SEQ ID NO: 30509 - DNA, 20 bp, Artificial Sequence
  Description of Artificial Sequence: Synthetic oligonucleotide
  Target: ATXN1; (-) strand; PAM type: NNNNGHTT; PAM sequence: ACTAGATT
atgtgcttcatggagacctt

SEQ ID NO: 30510 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
gggcacattaggcttttaat

SEQ ID NO: 30511 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
gaagccatgttaagggcaca

SEQ ID NO: 30512 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
atctaagtgaaggaaaaaag

SEQ ID NO: 30513 - DNA, 20 bp, Artificial Sequence
  Description of Artificial Sequence: Synthetic oligonucleotide
  Target: ATXN1; (-) strand; PAM type: NNNNGHTT; PAM sequence: AGTGGATT
cgagcagaaaggtattaccg

SEQ ID NO: 30514 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
tctattcagttttgactaaa

SEQ ID NO: 30515 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
tatcttctcccaggtctcta

SEQ ID NO: 30516 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gaagttgtggcaatcctgaa

SEQ ID NO: 30517 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
ttggctgttgcttagttcag

SEQ ID NO: 30518 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
tttatttggctgttgcttag

SEQ ID NO: 30519 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
ctttttctcttttatttggc

SEQ ID NO: 30520 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
atccaaacagaagaactcac

SEQ ID NO: 30521 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
aggagagatttgcagggcgt

SEQ ID NO: 30522 - DNA, 20 bp, Artificial Sequence
  Description of Artificial Sequence: Synthetic oligonucleotide
  Target: ATXN1; (-) strand; PAM type: NNNNGHTT; PAM sequence: GAGAGATT
cctggtcttggatgatccag

SEQ ID NO: 30523 - DNA, 20 bp, Artificial Sequence
  Description of Artificial Sequence: Synthetic oligonucleotide
  Target: ATXN1; (-) strand; PAM type: NNNNGHTT; PAM sequence: TCAGGATT
tacagtgcacagtggtggat

SEQ ID NO: 30524 - DNA, 20 bp, Artificial Sequence
  Description of Artificial Sequence: Synthetic oligonucleotide
  Target: ATXN1; (-) strand; PAM type: NNNNGHTT; PAM sequence: GGTGGATT
aagcacctacagtgcacagt

SEQ ID NO: 30525 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
ggtcccgctgctgaaaagga

SEQ ID NO: 30526 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
gctgttaggcctcgcaggtt

SEQ ID NO: 30527 - DNA, 20 bp, Artificial Sequence
  Description of Artificial Sequence: Synthetic oligonucleotide
  Target: ATXN1; (-) strand; PAM type: NNNNGHTT; PAM sequence: GGCAGTTT
aagccacacctgctaccctt

SEQ ID NO: 30528 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
gaaccggactgtgctaaact

SEQ ID NO: 30529 - DNA, 20 bp, Artificial Sequence
  Description of Artificial Sequence: Synthetic oligonucleotide
  Target: ATXN1; (-) strand; PAM type: NNNNGHTT; PAM sequence: CTAAGATT
gtaatgacaggagcccctga

SEQ ID NO: 30530 - DNA, 20 bp, Artificial Sequence
  Description of Artificial Sequence: Synthetic oligonucleotide
  Target: ATXN1; (-) strand; PAM type: NNNNGHTT; PAM sequence: CCAAGCTT
ttgcattccctcttcagttg

SEQ ID NO: 30531 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
atggtaggtgtccaggaaat

SEQ ID NO: 30532 - DNA, 20 bp, Artificial Sequence
  Description of Artificial Sequence: Synthetic oligonucleotide
  Target: ATXN1; (-) strand; PAM type: NNNNGHTT; PAM sequence: TGAGGTTT
cttagttaacttttgcacac

SEQ ID NO: 30533 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
aagttgcagattcagcaaca

SEQ ID NO: 30534 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
ttggatatgtttattaaagt

SEQ ID NO: 30535 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
cctgcttccgaatctcttgg

SEQ ID NO: 30536 - DNA, 20 bp, Artificial Sequence
  Description of Artificial Sequence: Synthetic oligonucleotide
  Target: ATXN1; (-) strand; PAM type: NNNNGHTT; PAM sequence: TCCTGCTT
ggtggtctaatcccagtacc

SEQ ID NO: 30537 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
gcaggaatcaaatcacagac

SEQ ID NO: 30538 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
acaattgcacatgggttgca

SEQ ID NO: 30539 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
actgctgtgcattactctgt

SEQ ID NO: 30540 - DNA, 20 bp, Artificial Sequence
  Description of Artificial Sequence: Synthetic oligonucleotide
  Target: ATXN1; (-) strand; PAM type: NNNNGHTT; PAM sequence: GCCTGCTT
gaacttctatcacatttagg

SEQ ID NO: 30541 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
tgccttggccttccaaagtg

SEQ ID NO: 30542 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttctatttttagtagaaa

SEQ ID NO: 30543 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcctgagtag

SEQ ID NO: 30544 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
tcgggaggtttgattaagac

SEQ ID NO: 30545 - DNA, 20 bp, Artificial Sequence
  Description of Artificial Sequence: Synthetic oligonucleotide
  Target: ATXN1; (-) strand; PAM type: NNNNGHTT; PAM sequence: GTTTGATT
ttgtcatgctgaatcgggag

SEQ ID NO: 30546 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
cactttgtcatgctgaatcg

SEQ ID NO: 30547 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
accctctttacctgtttgct

SEQ ID NO: 30548 - DNA, 20 bp, Artificial Sequence
  Description of Artificial Sequence: Synthetic oligonucleotide
  Target: ATXN1; (-) strand; PAM type: NNNNGHTT; PAM sequence: ACCTGTTT
tcaacataggaaccctcttt

SEQ ID NO: 30549 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
gttatctggaagtgctagtt

SEQ ID NO: 30550 - DNA, 20 bp, Artificial Sequence
  Description of Artificial Sequence: Synthetic oligonucleotide
  Target: ATXN1; (-) strand; PAM type: NNNNGHTT; PAM sequence: GCTAGTTT
acacagtgttatctggaagt

SEQ ID NO: 30551 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
gccttcaagtgatgcattat

SEQ ID NO: 30552 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
agatgtcactcttgttagca

SEQ ID NO: 30553 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
taaacatcccctttctgaag

SEQ ID NO: 30554 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
taaccctgtggatccccaca

SEQ ID NO: 30555 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
ggatctgactttttccttct

SEQ ID NO: 30556 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
gcttcttttgaaatactgtc

SEQ ID NO: 30557 - DNA, 20 bp, Artificial Sequence
  Description of Artificial Sequence: Synthetic oligonucleotide
  Target: ATXN1; (-) strand; PAM type: NNNNGHTT; PAM sequence: ATAGGCTT
attatatccaaataagtgag

SEQ ID NO: 30558 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgccttggcctctcaaagtg

SEQ ID NO: 30559 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
atcacgccatcaggggtaca

SEQ ID NO: 30560 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
actgctatgtgttgttctgt

SEQ ID NO: 30561 - DNA, 20 bp, Artificial Sequence
  Description of Artificial Sequence: Synthetic oligonucleotide
  Target: ATXN1; (-) strand; PAM type: NNNNGHTT; PAM sequence: CGTAGCTT
ctggactgcagtggtgcaat

SEQ ID NO: 30562 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
atttatttatttatttgaga

SEQ ID NO: 30563 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
cattaaaaaaaaatgtggca

SEQ ID NO: 30564 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaaagtg

SEQ ID NO: 30565 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttagtagagc

SEQ ID NO: 30566 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctccacctcccaggttc

SEQ ID NO: 30567 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gcatctgcagtaaataattt

SEQ ID NO: 30568 - DNA, 20 bp, Artificial Sequence
  Description of Artificial Sequence: Synthetic oligonucleotide
  Target: ATXN1; (-) strand; PAM type: NNNNGHTT; PAM sequence: GTAGGCTT
ttgcccaacagaatttctgt

SEQ ID NO: 30569 - DNA, 20 bp, Artificial Sequence
  Description of Artificial Sequence: Synthetic oligonucleotide
  Target: ATXN1; (-) strand; PAM type: NNNNGHTT; PAM sequence: GGGGGTTT
tgggcaaggtgaaagatgat

SEQ ID NO: 30570 - DNA, 20 bp, Artificial Sequence
  Description of Artificial Sequence: Synthetic oligonucleotide
  Target: ATXN1; (-) strand; PAM type: NNNNGHTT; PAM sequence: CCAGGTTT
tcactacagtagcatgccgt

SEQ ID NO: 30571 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
tgtaccttttctatgtttag

SEQ ID NO: 30572 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
gtattttggttgtacctttt

SEQ ID NO: 30573 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
tctcaaaaaaaaaaaaaaaa

SEQ ID NO: 30574 - DNA, 20 bp, Artificial Sequence
  Description of Artificial Sequence: Synthetic oligonucleotide
  Target: ATXN1; (-) strand; PAM type: NNNNGHTT; PAM sequence: CCGAGATT
gaggcagagcttgcagtgag

SEQ ID NO: 30575 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
aatggcgtgaacctgggagg

SEQ ID NO: 30576 - DNA, 20 bp, Artificial Sequence
  Description of Artificial Sequence: Synthetic oligonucleotide
  Target: ATXN1; (-) strand; PAM type: NNNNGHTT; PAM sequence: GGGCGCTT
aattagccgggtgtagtggc

SEQ ID NO: 30577 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
ggcgcgcggatcacgaggtc

SEQ ID NO: 30578 - DNA, 20 bp, Artificial Sequence
  Description of Artificial Sequence: Synthetic oligonucleotide
  Target: ATXN1; (-) strand; PAM type: NNNNGHTT; PAM sequence: ATAAGATT
acacgtattacagtggtccc

SEQ ID NO: 30579 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
tacagtcatgtgccacataa

SEQ ID NO: 30580 - DNA, 20 bp, Artificial Sequence
  Description of Artificial Sequence: Synthetic oligonucleotide
  Target: ATXN1; (-) strand; PAM type: NNNNGHTT; PAM sequence: GCAAGTTT
gaagtagattcaatttaatg

SEQ ID NO: 30581 - DNA, 20 bp, Artificial Sequence
  Description of Artificial Sequence: Synthetic oligonucleotide
  Target: ATXN1; (-) strand; PAM type: NNNNGHTT; PAM sequence: AGTAGATT
ggattaatcgcacgagagga

SEQ ID NO: 30582 - DNA, 20 bp, Artificial Sequence
  Description of Artificial Sequence: Synthetic oligonucleotide
  Target: ATXN1; (-) strand; PAM type: NNNNGHTT; PAM sequence: AAGGGATT
tccattttagctgaaaacat

SEQ ID NO: 30583 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
caaccgcatttactttatgt

SEQ ID NO: 30584 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
agagcaaccgcatttacttt

SEQ ID NO: 30585 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
atccaaaagacttgacatct

SEQ ID NO: 30586 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
acggatggtcttgaaacaca

SEQ ID NO: 30587 - DNA, 20 bp, Artificial Sequence
  Description of Artificial Sequence: Synthetic oligonucleotide
  Target: ATXN1; (-) strand; PAM type: NNNNGHTT; PAM sequence: AGTGGATT
accaggaacaagagagaaag

SEQ ID NO: 30588 - DNA, 20 bp, Artificial Sequence
  Description of Artificial Sequence: Synthetic oligonucleotide
  Target: ATXN1; (-) strand; PAM type: NNNNGHTT; PAM sequence: TGAAGCTT
catagtgaaagagtctattt

SEQ ID NO: 30589 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cattctgacttggtattttg

SEQ ID NO: 30590 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
attttcattctgacttggta

SEQ ID NO: 30591 - DNA, 20 bp, Artificial Sequence
  Description of Artificial Sequence: Synthetic oligonucleotide
  Target: ATXN1; (-) strand; PAM type: NNNNGHTT; PAM sequence: AACTGCTT
tttccccctgaatatccact

SEQ ID NO: 30592 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
aatatacatttgagaaaggc

SEQ ID NO: 30593 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
ttcatcctgataattaacat

SEQ ID NO: 30594 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
tggcttcatcctgataatta

SEQ ID NO: 30595 - DNA, 20 bp, Artificial Sequence
  Description of Artificial Sequence: Synthetic oligonucleotide
  Target: ATXN1; (-) strand; PAM type: NNNNGHTT; PAM sequence: GATGGCTT
cttatgtagataagcagtga

SEQ ID NO: 30596 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
gctacctcccccagtgtcat

SEQ ID NO: 30597 - DNA, 20 bp, Artificial Sequence
  Description of Artificial Sequence: Synthetic oligonucleotide
  Target: ATXN1; (-) strand; PAM type: NNNNGHTT; PAM sequence: TCATGCTT
acctgctacctcccccagtg

SEQ ID NO: 30598 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
tgcattcccactggtgtaca

SEQ ID NO: 30599 - DNA, 20 bp, Artificial Sequence
  Description of Artificial Sequence: Synthetic oligonucleotide
  Target: ATXN1; (-) strand; PAM type: NNNNGHTT; PAM sequence: AGTTGATT
atttaaaaagtattcacatc

SEQ ID NO: 30600 - DNA, 20 bp, Artificial Sequence
  Description of Artificial Sequence: Synthetic oligonucleotide
  Target: ATXN1; (-) strand; PAM type: NNNNGHTT; PAM sequence: TTATGCTT
aatggaaaatgttctctctc

SEQ ID NO: 30601 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
gtgtaaagtaactactgctt

SEQ ID NO: 30602 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
tattcagtgtgtaaagtaac

SEQ ID NO: 30603 - DNA, 20 bp, Artificial Sequence
  Description of Artificial Sequence: Synthetic oligonucleotide
  Target: ATXN1; (-) strand; PAM type: NNNNGHTT; PAM sequence: GTAGGCTT
gtcagacgaggttctaatgt

SEQ ID NO: 30604 - DNA, 20 bp, Artificial Sequence
  Description of Artificial Sequence: Synthetic oligonucleotide
  Target: ATXN1; (-) strand; PAM type: NNNNGHTT; PAM sequence: AGATGCTT
ggatttgactaagcatcaga

SEQ ID NO: 30605 - DNA, 20 bp, Artificial Sequence
  Description of Artificial Sequence: Synthetic oligonucleotide
  Target: ATXN1; (-) strand; PAM type: NNNNGHTT; PAM sequence: GGTGGATT
tgtcaaaaaacaaacagtgg

SEQ ID NO: 30606 - DNA, 20 bp, Artificial Sequence
  Description of Artificial Sequence: Synthetic oligonucleotide
  Target: ATXN1; (-) strand; PAM type: NNNNGHTT; PAM sequence: GACTGTTT
ggaggcagacacctttggaa

SEQ ID NO: 30607 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
aactggatgacagtcagccg

SEQ ID NO: 30608 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
gtgggacctttggagattta

SEQ ID NO: 30609 - DNA, 20 bp, Artificial Sequence
  Description of Artificial Sequence: Synthetic oligonucleotide
  Target: ATXN1; (-) strand; PAM type: NNNNGHTT; PAM sequence: TGGAGATT
gatgatcaccgtgggacctt

SEQ ID NO: 30610 - DNA, 20 bp, Artificial Sequence
  Description of Artificial Sequence: Synthetic oligonucleotide
  Target: ATXN1; (-) strand; PAM type: NNNNGHTT; PAM sequence: GTAAGCTT
aggaattagttattcacaca

SEQ ID NO: 30611 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
tccataaagtaatagttaca

SEQ ID NO: 30612 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
agagacactttctcctcctc

SEQ ID NO: 30613 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
gaatggcattatctcaactc

SEQ ID NO: 30614 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
gatagcatccaaaaaataaa

SEQ ID NO: 30615 - DNA, 20 bp, Artificial Sequence
  Description of Artificial Sequence: Synthetic oligonucleotide
  Target: ATXN1; (-) strand; PAM type: NNNNGHTT; PAM sequence: TGTTGATT
gctttgaacttcctggctta

SEQ ID NO: 30616 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
gtttgtcatgctttgaactt

SEQ ID NO: 30617 - DNA, 20 bp, Artificial Sequence
  Description of Artificial Sequence: Synthetic oligonucleotide
  Target: ATXN1; (-) strand; PAM type: NNNNGHTT; PAM sequence: TCATGCTT
ggtaaagtaaagacagtttg

SEQ ID NO: 30618 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
taccaagccggtaaagtaaa

SEQ ID NO: 30619 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
atcctcctcctctctccaaa

SEQ ID NO: 30620 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
aagccagtaacttgcagtga

SEQ ID NO: 30621 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
gatatttttagttaaaaaag

SEQ ID NO: 30622 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
accgcattacatttcattaa

SEQ ID NO: 30623 - DNA, 20 bp, Artificial Sequence
  Description of Artificial Sequence: Synthetic oligonucleotide
  Target: ATXN1; (-) strand; PAM type: NNNNGHTT; PAM sequence: GATCGATT
ggaccattctgcctctccca

SEQ ID NO: 30624 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
aaaccttacttttctggaca

SEQ ID NO: 30625 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
aagaagtgtgtagaattttc

SEQ ID NO: 30626 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
agagggaagcatattgaaat

SEQ ID NO: 30627 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
tattattaacggtattgata

SEQ ID NO: 30628 - DNA, 20 bp, Artificial Sequence
  Description of Artificial Sequence: Synthetic oligonucleotide
  Target: ATXN1; (-) strand; PAM type: NNNNGHTT; PAM sequence: TGTTGATT
aaacccaagccagtttgttt

SEQ ID NO: 30629 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
cagagattaaacccaagcca

SEQ ID NO: 30630 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
gtgacagagattaaacccaa

SEQ ID NO: 30631 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
aaacaagaagggataggtga

SEQ ID NO: 30632 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
ttttgggcttttggccttat

SEQ ID NO: 30633 - DNA, 20 bp, Artificial Sequence
  Description of Artificial Sequence: Synthetic oligonucleotide
  Target: ATXN1; (-) strand; PAM type: NNNNGHTT; PAM sequence: TTGGGCTT
tgtgctttctcttctgcttt

SEQ ID NO: 30634 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
ctaggcccctgtgctttctc

SEQ ID NO: 30635 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
tctgtgaatgccctaggccc

SEQ ID NO: 30636 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
ccatactttgctgctgctgc

SEQ ID NO: 30637 - DNA, 20 bp, Artificial Sequence
  Description of Artificial Sequence: Synthetic oligonucleotide
  Target: ATXN1; (-) strand; PAM type: NNNNGHTT; PAM sequence: CACTGTTT
atatttcatgactcccaggt

SEQ ID NO: 30638 - DNA, 20 bp, Artificial Sequence
  Description of Artificial Sequence: Synthetic oligonucleotide
  Target: ATXN1; (-) strand; PAM type: NNNNGHTT; PAM sequence: GATAGATT
tttaataagttcctttattt

SEQ ID NO: 30639 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
gttgtgtttgttatgatttt

SEQ ID NO: 30640 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
atataagatagttgtgtttg

SEQ ID NO: 30641 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
tagtaaatcatataagatag

SEQ ID NO: 30642 - DNA, 20 bp, Artificial Sequence
  Description of Artificial Sequence: Synthetic oligonucleotide
  Target: ATXN1; (-) strand; PAM type: NNNNGHTT; PAM sequence: ACCTGTTT
gagttgatattctactgaga

SEQ ID NO: 30643 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
ttgggagcctgaggcaggag

SEQ ID NO: 30644 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
ccaggtttcccagcactatt

SEQ ID NO: 30645 - DNA, 20 bp, Artificial Sequence
  Description of Artificial Sequence: Synthetic oligonucleotide
  Target: ATXN1; (-) strand; PAM type: NNNNGHTT; PAM sequence: CCAGGTTT
atctctttcgaaacgaagag

SEQ ID NO: 30646 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
atttgtataaacacatgttt

SEQ ID NO: 30647 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
atatgtatatttgtataaac

SEQ ID NO: 30648 - DNA, 20 bp, Artificial Sequence
  Description of Artificial Sequence: Synthetic oligonucleotide
  Target: ATXN1; (-) strand; PAM type: NNNNGHTT; PAM sequence: TCATGCTT
acaatggcctacaaggcctt

SEQ ID NO: 30649 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
aggctgcttataacagtaac

SEQ ID NO: 30650 - DNA, 20 bp, Artificial Sequence
  Description of Artificial Sequence: Synthetic oligonucleotide
  Target: ATXN1; (-) strand; PAM type: NNNNGHTT; PAM sequence: GGCTGCTT
tcactggaagccatcctgca

SEQ ID NO: 30651 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
taaatccagtccacactcaa

SEQ ID NO: 30652 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
ctcccattacctttgccaca

SEQ ID NO: 30653 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
atagggtgggggcggtaggg

SEQ ID NO: 30654 - DNA, 20 bp, Artificial Sequence
  Description of Artificial Sequence: Synthetic oligonucleotide
  Target: ATXN1; (-) strand; PAM type: NNNNGHTT; PAM sequence: TGACGTTT
gtcaagttgttaacctgggc

SEQ ID NO: 30655 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
acaacaagtgtttattatct

SEQ ID NO: 30656 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
tcttagtggcttaaaacaac

SEQ ID NO: 30657 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
aagtaattactccaaatctt

SEQ ID NO: 30658 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
gtcatgtaaagttcccagaa

SEQ ID NO: 30659 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
gtgatttaacttctttgggg

SEQ ID NO: 30660 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
atgtatgtgtgctgttgaac

SEQ ID NO: 30661 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
ggtttctggagtcagatggc

SEQ ID NO: 30662 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
tgtgatgcagggattaagaa

SEQ ID NO: 30663 - DNA, 20 bp, Artificial Sequence
  Description of Artificial Sequence: Synthetic oligonucleotide
  Target: ATXN1; (-) strand; PAM type: NNNNGHTT; PAM sequence: CAGGGATT
cttaaaggggtagtgtgatg

SEQ ID NO: 30664 - DNA, 20 bp, Artificial Sequence
  Description of Artificial Sequence: Synthetic oligonucleotide
  Target: ATXN1; (-) strand; PAM type: NNNNGHTT; PAM sequence: GTGTGATT
cttcattgcttgtgcaaatt

SEQ ID NO: 30665 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
tgatgaagatgcagatgctt

SEQ ID NO: 30666 - DNA, 20 bp, Artificial Sequence
  Description of Artificial Sequence: Synthetic oligonucleotide
  Target: ATXN1; (-) strand; PAM type: NNNNGHTT; PAM sequence: AGATGCTT
aagaagtttgatgaagatgc

SEQ ID NO: 30667 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
ctatttcaaaaaaaaaaaaa

SEQ ID NO: 30668 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
ttgggaggctgaggcaggag

SEQ ID NO: 30669 - DNA, 20 bp, Artificial Sequence
  Description of Artificial Sequence: Synthetic oligonucleotide
  Target: ATXN1; (-) strand; PAM type: NNNNGHTT; PAM sequence: TATAGCTT
tgttttctttgacaactgaa

SEQ ID NO: 30670 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
caaacagcaagaggctacct

SEQ ID NO: 30671 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
tttacaattgcaaaaagaca

SEQ ID NO: 30672 - DNA, 20 bp, Artificial Sequence
  Description of Artificial Sequence: Synthetic oligonucleotide
  Target: ATXN1; (-) strand; PAM type: NNNNGHTT; PAM sequence: AGTAGTTT
tgttcttttccttaccactg

SEQ ID NO: 30673 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
ttgggaggctgaggcaggag

SEQ ID NO: 30674 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
tggtggacgcctgtaatccc

SEQ ID NO: 30675 - DNA, 20 bp, Artificial Sequence
  Description of Artificial Sequence: Synthetic oligonucleotide
  Target: ATXN1; (-) strand; PAM type: NNNNGHTT; PAM sequence: TAAAGATT
tggtgaaaccccgtctctac

SEQ ID NO: 30676 - DNA, 20 bp, Artificial Sequence
  Description of Artificial Sequence: Synthetic oligonucleotide
  Target: ATXN1; (-) strand; PAM type: NNNNGHTT; PAM sequence: AATTGATT
actttctattgccaactgaa

SEQ ID NO: 30677 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
gttcctactgaaacacttcg

SEQ ID NO: 30678 - DNA, 20 bp, Artificial Sequence
  Description of Artificial Sequence: Synthetic oligonucleotide
  Target: ATXN1; (-) strand; PAM type: NNNNGHTT; PAM sequence: ACCAGTTT
tgatacttgcaccacccagc

SEQ ID NO: 30679 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
ttgggaggctgagctgggag

SEQ ID NO: 30680 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
tgattctttctttccagtgc

SEQ ID NO: 30681 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
tttttatgattctttctttc

SEQ ID NO: 30682 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
gggttttgttgtatttcttt

SEQ ID NO: 30683 - DNA, 20 bp, Artificial Sequence
  Description of Artificial Sequence: Synthetic oligonucleotide
  Target: ATXN1; (-) strand; PAM type: NNNNGHTT; PAM sequence: GTGGGTTT
agaaagatttagaaatggca

SEQ ID NO: 30684 - DNA, 20 bp, Artificial Sequence
  Description of Artificial Sequence: Synthetic oligonucleotide
  Target: ATXN1; (-) strand; PAM type: NNNNGHTT; PAM sequence: GAAAGATT
cacagtcactttgggtaaca

SEQ ID NO: 30685 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
cctagctgttgagctgttac

SEQ ID NO: 30686 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
atgcatatgtttttttaaag

SEQ ID NO: 30687 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
ctacttctgtttccaaatgc

SEQ ID NO: 30688 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
ctctttgaagctgtttctac

SEQ ID NO: 30689 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
attttgcttatactctttga

SEQ ID NO: 30690 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tcattcattgtattatgcca

SEQ ID NO: 30691 - DNA, 20 bp, Artificial Sequence
  Description of Artificial Sequence: Synthetic oligonucleotide
  Target: ATXN1; (-) strand; PAM type: NNNNGHTT; PAM sequence: ATCTGATT
cctataaaattcacttgcga

SEQ ID NO: 30692 - DNA, 20 bp, Artificial Sequence
  Description of Artificial Sequence: Synthetic oligonucleotide
  Target: ATXN1; (-) strand; PAM type: NNNNGHTT; PAM sequence: CATAGATT
agatgagtgctttctcccct

SEQ ID NO: 30693 - DNA, 20 bp, Artificial Sequence
  Description of Artificial Sequence: Synthetic oligonucleotide
  Target: ATXN1; (-) strand; PAM type: NNNNGHTT; PAM sequence: GAGTGCTT
aatatattttgggcctagat

SEQ ID NO: 30694 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
agtgtctacaccctgtgtcc

SEQ ID NO: 30695 - DNA, 20 bp, Artificial Sequence
  Description of Artificial Sequence: Synthetic oligonucleotide
  Target: ATXN1; (-) strand; PAM type: NNNNGHTT; PAM sequence: AGGAGCTT
taaaatttattgaggaccca

SEQ ID NO: 30696 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
atattttacatttttctcaa

SEQ ID NO: 30697 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
ctttaagaaactaccactta

SEQ ID NO: 30698 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
cttagagtttatttctatgc

SEQ ID NO: 30699 - DNA, 20 bp, Artificial Sequence
  Description of Artificial Sequence: Synthetic oligonucleotide
  Target: ATXN1; (-) strand; PAM type: NNNNGHTT; PAM sequence: CTATGCTT
agaatacttagagtttattt

SEQ ID NO: 30700 - DNA, 20 bp, Artificial Sequence
  Description of Artificial Sequence: Synthetic oligonucleotide
  Target: ATXN1; (-) strand; PAM type: NNNNGHTT; PAM sequence: TAGAGTTT
ttttaatataaaagaatact

SEQ ID NO: 30701 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
aatgaaatgtgtcaactttt

SEQ ID NO: 30702 - DNA, 20 bp, Artificial Sequence
  Description of Artificial Sequence: Synthetic oligonucleotide
  Target: ATXN1; (-) strand; PAM type: NNNNGHTT; PAM sequence: CGGAGTTT
attctcttccatgtgtacag

SEQ ID NO: 30703 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
ctggagggacatctgtaaga

SEQ ID NO: 30704 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttacttccagtagggatctg

SEQ ID NO: 30705 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
ccagaaggaaacctagagtt

SEQ ID NO: 30706 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
actcttccctctggtgccct

SEQ ID NO: 30707 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
cctagtagaatccaagtaaa

SEQ ID NO: 30708 - DNA, 20 bp, Artificial Sequence
  Description of Artificial Sequence: Synthetic oligonucleotide
  Target: ATXN1; (-) strand; PAM type: NNNNGHTT; PAM sequence: CACAGTTT
aattaaaaatgcacacttct

SEQ ID NO: 30709 - DNA, 20 bp, Artificial Sequence
  Description of Artificial Sequence: Synthetic oligonucleotide
  Target: ATXN1; (-) strand; PAM type: NNNNGHTT; PAM sequence: GTGTGCTT
tgatttgaccattacacatt

SEQ ID NO: 30710 - DNA, 20 bp, Artificial Sequence
  Description of Artificial Sequence: Synthetic oligonucleotide
  Target: ATXN1; (-) strand; PAM type: NNNNGHTT; PAM sequence: CCTTGATT
agtgatgggtatcccaaata

SEQ ID NO: 30711 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
ttgaagagatacctgcactc

SEQ ID NO: 30712 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
ttaaagcctagattggaaga

SEQ ID NO: 30713 - DNA, 20 bp, Artificial Sequence
  Description of Artificial Sequence: Synthetic oligonucleotide
  Target: ATXN1; (-) strand; PAM type: NNNNGHTT; PAM sequence: CCTAGATT
ttttaactagattcttaaag

SEQ ID NO: 30714 - DNA, 20 bp, Artificial Sequence
  Description of Artificial Sequence: Synthetic oligonucleotide
  Target: ATXN1; (-) strand; PAM type: NNNNGHTT; PAM sequence: ACTAGATT
tttagttaaaagaaatttta

SEQ ID NO: 30715 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
aatctctttccatgtacttt

SEQ ID NO: 30716 - DNA, 20 bp, Artificial Sequence
  Description of Artificial Sequence: Synthetic oligonucleotide
  Target: ATXN1; (-) strand; PAM type: NNNNGHTT; PAM sequence: AATTGATT
atttacctagttacttcatg

SEQ ID NO: 30717 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
gtattttctttctaaataga

SEQ ID NO: 30718 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
taacacccaaagataaccag

SEQ ID NO: 30719 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
tagaggagataatgaaactc

SEQ ID NO: 30720 - DNA, 20 bp, Artificial Sequence
  Description of Artificial Sequence: Synthetic oligonucleotide
  Target: ATXN1; (-) strand; PAM type: NNNNGHTT; PAM sequence: TAGGGCTT
tccactgcctaggatggttc

SEQ ID NO: 30721 - DNA, 20 bp, Artificial Sequence
  Description of Artificial Sequence: Synthetic oligonucleotide
  Target: ATXN1; (-) strand; PAM type: NNNNGHTT; PAM sequence: TCATGATT
aagaaagtgaagaggatgtt

SEQ ID NO: 30722 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
ttgaaacaagaaagtgaaga

SEQ ID NO: 30723 - DNA, 20 bp, Artificial Sequence
  Description of Artificial Sequence: Synthetic oligonucleotide
  Target: ATXN1; (-) strand; PAM type: NNNNGHTT; PAM sequence: GTCTGCTT
ctttttccatgtgataaccg

SEQ ID NO: 30724 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
taacctcacagaatccagcg

SEQ ID NO: 30725 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
ctcatgtccttctaagaatc

SEQ ID NO: 30726 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
attttgtttacagaccatca

SEQ ID NO: 30727 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tgggctgaggataccttgaa

SEQ ID NO: 30728 - DNA, 20 bp, Artificial Sequence
  Description of Artificial Sequence: Synthetic oligonucleotide
  Target: ATXN1; (-) strand; PAM type: NNNNGHTT; PAM sequence: AGGGGATT
gtgctttcagaggaataaac

SEQ ID NO: 30729 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
ttgcagagcttgtttcataa

SEQ ID NO: 30730 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
atgactggcatttttgcaga

SEQ ID NO: 30731 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
agagatgactggcatttttg

SEQ ID NO: 30732 - DNA, 20 bp, Artificial Sequence
  Description of Artificial Sequence: Synthetic oligonucleotide
  Target: ATXN1; (-) strand; PAM type: NNNNGHTT; PAM sequence: AAGCGTTT
tcaactgacccaagggagtt

SEQ ID NO: 30733 - DNA, 20 bp, Artificial Sequence
  Description of Artificial Sequence: Synthetic oligonucleotide
  Target: ATXN1; (-) strand; PAM type: NNNNGHTT; PAM sequence: TAACGATT
gaaagtgttcagtatgtttt

SEQ ID NO: 30734 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
aataatctagaaagtgttca

SEQ ID NO: 30735 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
tgccttgagagatttctcta

SEQ ID NO: 30736 - DNA, 20 bp, Artificial Sequence
  Description of Artificial Sequence: Synthetic oligonucleotide
  Target: ATXN1; (-) strand; PAM type: NNNNGHTT; PAM sequence: GAGAGATT
ggcactatgtgcactgcctt

SEQ ID NO: 30737 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
actctcaagaccaaaaggca

SEQ ID NO: 30738 - DNA, 20 bp, Artificial Sequence
  Description of Artificial Sequence: Synthetic oligonucleotide
  Target: ATXN1; (-) strand; PAM type: NNNNGHTT; PAM sequence: TAAAGCTT
ctgttctctttaataatatc

SEQ ID NO: 30739 - DNA, 20 bp, Artificial Sequence
  Description of Artificial Sequence: Synthetic oligonucleotide
  Target: ATXN1; (-) strand; PAM type: NNNNGHTT; PAM sequence: TGGAGCTT
aagtcacaaataaactagca

SEQ ID NO: 30740 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
actatcctactttattctat

SEQ ID NO: 30741 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
actgaaaacagaggtatacg

SEQ ID NO: 30742 - DNA, 20 bp, Artificial Sequence
  Description of Artificial Sequence: Synthetic oligonucleotide
  Target: ATXN1; (-) strand; PAM type: NNNNGHTT; PAM sequence: ACCAGTTT
taaaataataaaagctccat

SEQ ID NO: 30743 - DNA, 20 bp, Artificial Sequence
  Description of Artificial Sequence: Synthetic oligonucleotide
  Target: ATXN1; (-) strand; PAM type: NNNNGHTT; PAM sequence: GATTGCTT
ccaggaggccaaggtgggag

SEQ ID NO: 30744 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
ttacccaggaggccaaggtg

SEQ ID NO: 30745 - DNA, 20 bp, Artificial Sequence
  Description of Artificial Sequence: Synthetic oligonucleotide
  Target: ATXN1; (-) strand; PAM type: NNNNGHTT; PAM sequence: CTGGGCTT
ccaagaaaatggggtggatt

SEQ ID NO: 30746 - DNA, 20 bp, Artificial Sequence
  Description of Artificial Sequence: Synthetic oligonucleotide
  Target: ATXN1; (-) strand; PAM type: NNNNGHTT; PAM sequence: GGTGGATT
ttatgatgccaagaaaatgg

SEQ ID NO: 30747 - DNA, 20 bp, Artificial Sequence
  Description of Artificial Sequence: Synthetic oligonucleotide
  Target: ATXN1; (-) strand; PAM type: NNNNGHTT; PAM sequence: GCTTGATT
ggaggattgttgttattatt

SEQ ID NO: 30748 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
tatgggaggattgttgttat

SEQ ID NO: 30749 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
cgtgagtttgacatactatg

SEQ ID NO: 30750 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
ggaggagaaggaaatgcctc

SEQ ID NO: 30751 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
ttggtttgtctgagagaaag

SEQ ID NO: 30752 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
aaaatacatgtcttcaatta

SEQ ID NO: 30753 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
tcctttcttaacttctgcac

SEQ ID NO: 30754 - DNA, 20 bp, Artificial Sequence
  Description of Artificial Sequence: Synthetic oligonucleotide
  Target: ATXN1; (-) strand; PAM type: NNNNGHTT; PAM sequence: GAGTGATT
gtcattaggaataagcatta

SEQ ID NO: 30755 - DNA, 20 bp, Artificial Sequence
  Description of Artificial Sequence: Synthetic oligonucleotide
  Target: ATXN1; (-) strand; PAM type: NNNNGHTT; PAM sequence: TGGAGCTT
aacttgtgtgattctataaa

SEQ ID NO: 30756 - DNA, 20 bp, Artificial Sequence
  Description of Artificial Sequence: Synthetic oligonucleotide
  Target: ATXN1; (-) strand; PAM type: NNNNGHTT; PAM sequence: GTGTGATT
tcagaggaaggcaaaaactt

SEQ ID NO: 30757 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
aaaagggtaagatcagggtg

SEQ ID NO: 30758 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
tgccggatggaaaaagagaa

SEQ ID NO: 30759 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
aattctttactgattaatag

SEQ ID NO: 30760 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
aaatagggacatcaattctt

SEQ ID NO: 30761 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
tcagttcagagagcaatagg

SEQ ID NO: 30762 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
gtaaaaaaaaaaaaaaaaaa

SEQ ID NO: 30763 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
ggacaaatacctaatgcatt

SEQ ID NO: 30764 - DNA, 20 bp, Artificial Sequence
  Description of Artificial Sequence: Synthetic oligonucleotide
  Target: ATXN1; (-) strand; PAM type: NNNNGHTT; PAM sequence: GTCAGCTT
tggttgggggtcatggggtg

SEQ ID NO: 30765 - DNA, 20 bp, Artificial Sequence
  Description of Artificial Sequence: Synthetic oligonucleotide
  Target: ATXN1; (-) strand; PAM type: NNNNGHTT; PAM sequence: GTTGGCTT
gcccaccctggcttctctgt

SEQ ID NO: 30766 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
gagtctctctgagcgcccac

SEQ ID NO: 30767 - DNA, 20 bp, Artificial Sequence
  Description of Artificial Sequence: Synthetic oligonucleotide
  Target: ATXN1; (-) strand; PAM type: NNNNGHTT; PAM sequence: ACAGGCTT
gtgatattggggtaccagga

SEQ ID NO: 30768 - DNA, 20 bp, Artificial Sequence
  Description of Artificial Sequence: Synthetic oligonucleotide
  Target: ATXN1; (-) strand; PAM type: NNNNGHTT; PAM sequence: AGTTGATT
aataagggggaaggcagagg

SEQ ID NO: 30769 - DNA, 20 bp, Artificial Sequence
  Description of Artificial Sequence: Synthetic oligonucleotide
  Target: ATXN1; (-) strand; PAM type: NNNNGHTT; PAM sequence: ATAGGATT
ataaccaggaaatagaattg

SEQ ID NO: 30770 - DNA, 20 bp, Artificial Sequence
  Description of Artificial Sequence: Synthetic oligonucleotide
  Target: ATXN1; (-) strand; PAM type: NNNNGHTT; PAM sequence: GAAGGATT
ttgctggagaggcagaaagg

SEQ ID NO: 30771 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
gcttttgtggcattctggag

SEQ ID NO: 30772 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
tcagatctgtattttctaga

SEQ ID NO: 30773 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
atactgcagtcaccatggtt

SEQ ID NO: 30774 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
ggagagtatactgcagtcac

SEQ ID NO: 30775 - DNA, 20 bp, Artificial Sequence
  Description of Artificial Sequence: Synthetic oligonucleotide
  Target: ATXN1; (-) strand; PAM type: NNNNGHTT; PAM sequence: GATAGTTT
catcccccttcctctttagt

SEQ ID NO: 30776 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
cgcagagagtaatgtactgt

SEQ ID NO: 30777 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
ttttctccagatctcttttt

SEQ ID NO: 30778 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
cctctgcatgtatcctccac

SEQ ID NO: 30779 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
catgcttctaggatcatttt

SEQ ID NO: 30780 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
acttggcagtgcctcacagg

SEQ ID NO: 30781 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
ttctttagcctgacttctag

SEQ ID NO: 30782 - DNA, 20 bp, Artificial Sequence
  Description of Artificial Sequence: Synthetic oligonucleotide
  Target: ATXN1; (-) strand; PAM type: NNNNGHTT; PAM sequence: AACTGCTT
acatttgtttctgttttagt

SEQ ID NO: 30783 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
agattaaaaataacatttgt

SEQ ID NO: 30784 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
agccagagattaaaaataac

SEQ ID NO: 30785 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
cttgtcagtttacagtgagc

SEQ ID NO: 30786 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
aaaattcatattcatatctt

SEQ ID NO: 30787 - DNA, 20 bp, Artificial Sequence
  Description of Artificial Sequence: Synthetic oligonucleotide
  Target: ATXN1; (-) strand; PAM type: NNNNGHTT; PAM sequence: TCTAGATT
gtaatgaggatggtttgtaa

SEQ ID NO: 30788 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
agtaaatggactgtaatgag

SEQ ID NO: 30789 - DNA, 20 bp, Artificial Sequence
  Description of Artificial Sequence: Synthetic oligonucleotide
  Target: ATXN1; (-) strand; PAM type: NNNNGHTT; PAM sequence: CTAAGCTT
aatttcagaatagttattca

SEQ ID NO: 30790 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
tttttcagctattggttttc

SEQ ID NO: 30791 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
catcttacaatttttcagct

SEQ ID NO: 30792 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
aagaaaagtgccaattgtgt

SEQ ID NO: 30793 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
ttaactgtagaaacacattg

SEQ ID NO: 30794 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
aaatgttaactgtagaaaca

SEQ ID NO: 30795 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
ctgtcattccatgtttgttt

SEQ ID NO: 30796 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
taaccaggctgtcattccat

SEQ ID NO: 30797 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
tttgtaaccaggctgtcatt

SEQ ID NO: 30798 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
tgtgttgatataaatatgcc

SEQ ID NO: 30799 - DNA, 20 bp, Artificial Sequence
  Description of Artificial Sequence: Synthetic oligonucleotide
  Target: ATXN1; (-) strand; PAM type: NNNNGHTT; PAM sequence: GTGTGATT
ttaagactgtcatcttttct

SEQ ID NO: 30800 - DNA, 20 bp, Artificial Sequence
  Description of Artificial Sequence: Synthetic oligonucleotide
  Target: ATXN1; (-) strand; PAM type: NNNNGHTT; PAM sequence: CCTTGATT
aaatatataatgattttgac

SEQ ID NO: 30801 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
atattcgtattcaaaatata

SEQ ID NO: 30802 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
tacatgtcagggaatgtgat

SEQ ID NO: 30803 - DNA, 20 bp, Artificial Sequence
  Description of Artificial Sequence: Synthetic oligonucleotide
  Target: ATXN1; (-) strand; PAM type: NNNNGHTT; PAM sequence: ATGTGATT
tttcagttacatgtcaggga

SEQ ID NO: 30804 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
acaaaggtacattttaatca

SEQ ID NO: 30805 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
tacttttaacgagcaccctc

SEQ ID NO: 30806 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
caacttagtcctgttgaaaa

SEQ ID NO: 30807 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
tttggaggatgttgaaaagt

SEQ ID NO: 30808 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
tttttcctgtggtataattt

SEQ ID NO: 30809 - DNA, 20 bp, Artificial Sequence
  Description of Artificial Sequence: Synthetic oligonucleotide
  Target: ATXN1; (-) strand; PAM type: NNNNGHTT; PAM sequence: ATGGGTTT
gcaaaagaagtgttataaaa

SEQ ID NO: 30810 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
ttctggggattaggacgtgg

SEQ ID NO: 30811 - DNA, 20 bp, Artificial Sequence
  Description of Artificial Sequence: Synthetic oligonucleotide
  Target: ATXN1; (-) strand; PAM type: NNNNGHTT; PAM sequence: TGGGGATT
acgaattcacagactgattc

SEQ ID NO: 30812 - DNA, 20 bp, Artificial Sequence
  Description of Artificial Sequence: Synthetic oligonucleotide
  Target: ATXN1; (-) strand; PAM type: NNNNGHTT; PAM sequence: GACTGATT
gcttttaccacgaattcaca

SEQ ID NO: 30813 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
taatgtcatcacatctgtga

SEQ ID NO: 30814 - DNA, 20 bp, Artificial Sequence
  Description of Artificial Sequence: Synthetic oligonucleotide
  Target: ATXN1; (-) strand; PAM type: NNNNGHTT; PAM sequence: TTGCGATT
tctcagacttttaaacttcc

SEQ ID NO: 30815 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
caatgttgcatctctctgtg

SEQ ID NO: 30816 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
attttatatttttactagag

SEQ ID NO: 30817 - DNA, 20 bp, Artificial Sequence
  Description of Artificial Sequence: Synthetic oligonucleotide
  Target: ATXN1; (-) strand; PAM type: NNNNGHTT; PAM sequence: TTCCGTTT
ataattcatatccttgcctt

SEQ ID NO: 30818 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
ggaactttgtggcttaaagc

SEQ ID NO: 30819 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
taacaacttatcaggaactt

SEQ ID NO: 30820 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
agtttcttcaaagcacctgt

SEQ ID NO: 30821 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
gcctttgtgttagaggtgac

SEQ ID NO: 30822 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
atatttgggattctgtcttt

SEQ ID NO: 30823 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
catttgtgccaaattaatat

SEQ ID NO: 30824 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
gccttagaccctttccttct

SEQ ID NO: 30825 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
tcttgaatgaatgaatgaat

SEQ ID NO: 30826 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
caggaggatcgcctgagctc

SEQ ID NO: 30827 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
tgccctctcaggacatttgg

SEQ ID NO: 30828 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
gtggttgaattctgagtttg

SEQ ID NO: 30829 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
aaaagtcctgtggttgaatt

SEQ ID NO: 30830 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
tgcgggtcattgtggaaaag

SEQ ID NO: 30831 - DNA, 20 bp, Artificial Sequence
  Description of Artificial Sequence: Synthetic oligonucleotide
  Target: ATXN1; (-) strand; PAM type: NNNNGHTT; PAM sequence: GTGAGCTT
agcagcagtatggatgaatt

SEQ ID NO: 30832 - DNA, 20 bp, Artificial Sequence
  Description of Artificial Sequence: Synthetic oligonucleotide
  Target: ATXN1; (-) strand; PAM type: NNNNGHTT; PAM sequence: CGGAGCTT
aatcgcttgaacccatgagg

SEQ ID NO: 30833 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
ttgggaggctgaggcaggag

SEQ ID NO: 30834 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
ggtgggcagatcatgaggtg

SEQ ID NO: 30835 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
tgtgctaaaccttctgattg

SEQ ID NO: 30836 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
ggtctacactgtgctaaacc

SEQ ID NO: 30837 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
ccaggatctcattccaaacc

SEQ ID NO: 30838 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
atgatctgtttctctaggag

SEQ ID NO: 30839 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
aaaaacttgctgaggaaatg

SEQ ID NO: 30840 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
aaaacaggatcttttcacat

SEQ ID NO: 30841 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
acacaaaacaggatcttttc

SEQ ID NO: 30842 - DNA, 20 bp, Artificial Sequence
  Description of Artificial Sequence: Synthetic oligonucleotide
  Target: ATXN1; (-) strand; PAM type: NNNNGHTT; PAM sequence: TACTGCTT
tgggggctatgtttccagtt

SEQ ID NO: 30843 - DNA, 20 bp, Artificial Sequence
  Description of Artificial Sequence: Synthetic oligonucleotide
  Target: ATXN1; (-) strand; PAM type: NNNNGHTT; PAM sequence: TCCAGTTT
gaaagaatgggggctatgtt

SEQ ID NO: 30844 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
gatttcagaaagaatggggg

SEQ ID NO: 30845 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
ccttggaagctgcagtctgt

SEQ ID NO: 30846 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
atccaaccttggaagctgca

SEQ ID NO: 30847 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
ttcagagagctctgctgggc

SEQ ID NO: 30848 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
gcacggactcatacggcagt

SEQ ID NO: 30849 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
ggactatggtgcaattgaag

SEQ ID NO: 30850 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
atcctcagtcatgtgatatt

SEQ ID NO: 30851 - DNA, 20 bp, Artificial Sequence
  Description of Artificial Sequence: Synthetic oligonucleotide
  Target: ATXN1; (-) strand; PAM type: NNNNGHTT; PAM sequence: GTGTGATT
gattccctaatgagtatgtt

SEQ ID NO: 30852 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
tatctgaaagggggaaaggg

SEQ ID NO: 30853 - DNA, 20 bp, Artificial Sequence
  Description of Artificial Sequence: Synthetic oligonucleotide
  Target: ATXN1; (-) strand; PAM type: NNNNGHTT; PAM sequence: CTTCGTTT
acatataaattccctccacc

SEQ ID NO: 30854 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
agcctcagcctcccaaagtg

SEQ ID NO: 30855 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
tatattttttttagtagaga

SEQ ID NO: 30856 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
agcctccacctcccaggttc

SEQ ID NO: 30857 - DNA, 20 bp, Artificial Sequence
  Description of Artificial Sequence: Synthetic oligonucleotide
  Target: ATXN1; (-) strand; PAM type: NNNNGHTT; PAM sequence: GTCCGCTT
tgttccttccccataaccct

SEQ ID NO: 30858 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
cttcatggtgttacctgcct

SEQ ID NO: 30859 - DNA, 20 bp, Artificial Sequence
  Description of Artificial Sequence: Synthetic oligonucleotide
  Target: ATXN1; (-) strand; PAM type: NNNNGHTT; PAM sequence: ACAGGCTT
tgggtagccagattagagac

SEQ ID NO: 30860 - DNA, 20 bp, Artificial Sequence
  Description of Artificial Sequence: Synthetic oligonucleotide
  Target: ATXN1; (-) strand; PAM type: NNNNGHTT; PAM sequence: GCCAGATT
ttagtagccttatttgggta

SEQ ID NO: 30861 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
aaataatgtactactttgta

SEQ ID NO: 30862 - DNA, 20 bp, Artificial Sequence
  Description of Artificial Sequence: Synthetic oligonucleotide
  Target: ATXN1; (-) strand; PAM type: NNNNGHTT; PAM sequence: GTGGGTTT
gttttcataggctgttaatt

SEQ ID NO: 30863 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
tagtgctaataccagaaaga

SEQ ID NO: 30864 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
cactcagtaatgaagaagta

SEQ ID NO: 30865 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tcgtggcatactctgccatt

SEQ ID NO: 30866 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
ataatcgtggcatactctgc

SEQ ID NO: 30867 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
agaatccattccaccactca

SEQ ID NO: 30868 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
tgtagttaaatctggtagga

SEQ ID NO: 30869 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
ttgaacattccagagtagag

SEQ ID NO: 30870 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
tgatggaatagaaaaaaaaa

SEQ ID NO: 30871 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
cactacagacatgattcatt

SEQ ID NO: 30872 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
gctcgcagtggccactacag

SEQ ID NO: 30873 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
gttcctttttacatttccca

SEQ ID NO: 30874 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
tcacaccgtattgtttgttt

SEQ ID NO: 30875 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
cccttgattcacaccgtatt

SEQ ID NO: 30876 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
attccccttgattcacaccg

SEQ ID NO: 30877 - DNA, 20 bp, Artificial Sequence
  Description of Artificial Sequence: Synthetic oligonucleotide
  Target: ATXN1; (-) strand; PAM type: NNNNGHTT; PAM sequence: CCTTGATT
tcagcgctcacccacattcc

SEQ ID NO: 30878 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
tacgtgggattttcaaatag

SEQ ID NO: 30879 - DNA, 20 bp, Artificial Sequence
  Description of Artificial Sequence: Synthetic oligonucleotide
  Target: ATXN1; (-) strand; PAM type: NNNNGHTT; PAM sequence: GTGGGATT
ctccctgtcctcttacctac

SEQ ID NO: 30880 - DNA, 20 bp, Artificial Sequence
  Description of Artificial Sequence: Synthetic oligonucleotide
  Target: ATXN1; (-) strand; PAM type: NNNNGHTT; PAM sequence: CTAGGCTT
gacttgtaaaaataacatgg

SEQ ID NO: 30881 - DNA, 20 bp, Artificial Sequence
  Description of Artificial Sequence: Synthetic oligonucleotide
  Target: ATXN1; (-) strand; PAM type: NNNNGHTT; PAM sequence: ACAAGTTT
tggaaaaaaaattctactat

SEQ ID NO: 30882 - DNA, 20 bp, Artificial Sequence
  Description of Artificial Sequence: Synthetic oligonucleotide
  Target: ATXN1; (-) strand; PAM type: NNNNGHTT; PAM sequence: GTCAGCTT
gcagacaacggcacaaatgt

SEQ ID NO: 30883 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
tagctgcttaaaaaggaatt

SEQ ID NO: 30884 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
aaagacataggtgaacattt

SEQ ID NO: 30885 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
tatctgaatttcatcagttg

SEQ ID NO: 30886 - DNA, 20 bp, Artificial Sequence
  Description of Artificial Sequence: Synthetic oligonucleotide
  Target: ATXN1; (-) strand; PAM type: NNNNGHTT; PAM sequence: GCAAGTTT
aaaacattttggctagagca

SEQ ID NO: 30887 - DNA, 20 bp, Artificial Sequence
  Description of Artificial Sequence: Synthetic oligonucleotide
  Target: ATXN1; (-) strand; PAM type: NNNNGHTT; PAM sequence: GTCAGATT
ttaaaatagatatccaagaa

SEQ ID NO: 30888 - DNA, 20 bp, Artificial Sequence
  Description of Artificial Sequence: Synthetic oligonucleotide
  Target: ATXN1; (-) strand; PAM type: NNNNGHTT; PAM sequence: GTAAGATT
attgttagtaagaatttgaa

SEQ ID NO: 30889 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
ataagatagaataaaaatga

SEQ ID NO: 30890 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
taactgtaagaaaataacat

SEQ ID NO: 30891 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
gttcctactcagctttctgt

SEQ ID NO: 30892 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
ttccacatcctatgttccta

SEQ ID NO: 30893 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgcctcggcctcccaaagtg

SEQ ID NO: 30894 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
tttgtatgtttttgtagaga

SEQ ID NO: 30895 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
caccacagccagctaatttt

SEQ ID NO: 30896 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaagtag

SEQ ID NO: 30897 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctctgtctctcgagttc

SEQ ID NO: 30898 - DNA, 20 bp, Artificial Sequence
  Description of Artificial Sequence: Synthetic oligonucleotide
  Target: ATXN1; (-) strand; PAM type: NNNNGHTT; PAM sequence: CTCGGCTT
ctggggtgcagtggcgtgat

SEQ ID NO: 30899 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
ttctttttttttttttgaga

SEQ ID NO: 30900 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
taattttgactatatatgac

SEQ ID NO: 30901 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
gagtgtcttgtgggaaagcc

SEQ ID NO: 30902 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
gtgtacatgaaaagtgcagt

SEQ ID NO: 30903 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
atacttaattttaaaagagg

SEQ ID NO: 30904 - DNA, 20 bp, Artificial Sequence
  Description of Artificial Sequence: Synthetic oligonucleotide
  Target: ATXN1; (-) strand; PAM type: NNNNGHTT; PAM sequence: CCCCGTTT
tacttatctttatctaatcc

SEQ ID NO: 30905 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
ttaatattcattaaagttaa

SEQ ID NO: 30906 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
tttttgacacttacttgact

SEQ ID NO: 30907 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
tggggggtagggggcctttc

SEQ ID NO: 30908 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
gaaaaggaaggaacagaagg

SEQ ID NO: 30909 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
tgctttggaactcagcacac

SEQ ID NO: 30910 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
gaaaagtataatggatgaga

SEQ ID NO: 30911 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
gttaatcctcccggaggaat

SEQ ID NO: 30912 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
accacacagcttgttagtat

SEQ ID NO: 30913 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
agggtctgatgaatgaacca

SEQ ID NO: 30914 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
ataggacagtaactggtttc

SEQ ID NO: 30915 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
agttggagcataggacagta

SEQ ID NO: 30916 - DNA, 20 bp, Artificial Sequence
  Description of Artificial Sequence: Synthetic oligonucleotide
  Target: ATXN1; (-) strand; PAM type: NNNNGHTT; PAM sequence: TAAGGTTT
tacttgtatttgtttcattt

SEQ ID NO: 30917 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
gaaaaacacccattacttgt

SEQ ID NO: 30918 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
tcatacttcagcttttttct

SEQ ID NO: 30919 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
tcccgtattgatggtcatac

SEQ ID NO: 30920 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
tattttttctttatgcccac

SEQ ID NO: 30921 - DNA, 20 bp, Artificial Sequence
  Description of Artificial Sequence: Synthetic oligonucleotide
  Target: ATXN1; (-) strand; PAM type: NNNNGHTT; PAM sequence: TTATGCTT
aaataatgaagggtggaata

SEQ ID NO: 30922 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
ccactcattttagctcaatc

SEQ ID NO: 30923 - DNA, 20 bp, Artificial Sequence
  Description of Artificial Sequence: Synthetic oligonucleotide
  Target: ATXN1; (-) strand; PAM type: NNNNGHTT; PAM sequence: TGTAGCTT
ccacacacaatttttggtct

SEQ ID NO: 30924 - DNA, 20 bp, Artificial Sequence
  Description of Artificial Sequence: Synthetic oligonucleotide
  Target: ATXN1; (-) strand; PAM type: NNNNGHTT; PAM sequence: AATTGATT
tcatgtctcccttcctttgg

SEQ ID NO: 30925 - DNA, 20 bp, Artificial Sequence
  Description of Artificial Sequence: Synthetic oligonucleotide
  Target: ATXN1; (-) strand; PAM type: NNNNGHTT; PAM sequence: CACAGATT
tcaggggcattgttgattga

SEQ ID NO: 30926 - DNA, 20 bp, Artificial Sequence
  Description of Artificial Sequence: Synthetic oligonucleotide
  Target: ATXN1; (-) strand; PAM type: NNNNGHTT; PAM sequence: TGTTGATT
ctggtttacttcaggggcat

SEQ ID NO: 30927 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
gactgtgcagtgcggacctg

SEQ ID NO: 30928 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
gtgtggctctggtcctgtgc

SEQ ID NO: 30929 - DNA, 20 bp, Artificial Sequence
  Description of Artificial Sequence: Synthetic oligonucleotide
  Target: ATXN1; (-) strand; PAM type: NNNNGHTT; PAM sequence: GCAGGCTT
ccatggcgtcaccctacact

SEQ ID NO: 30930 - DNA, 20 bp, Artificial Sequence
  Description of Artificial Sequence: Synthetic oligonucleotide
  Target: ATXN1; (-) strand; PAM type: NNNNGHTT; PAM sequence: AACAGCTT
ctctaaatactactgacagt

SEQ ID NO: 30931 - DNA, 20 bp, Artificial Sequence
  Description of Artificial Sequence: Synthetic oligonucleotide
  Target: ATXN1; (-) strand; PAM type: NNNNGHTT; PAM sequence: AGTTGATT
ataaacagttcaacagaagc

SEQ ID NO: 30932 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
agttgcataatggcagttac

SEQ ID NO: 30933 - DNA, 20 bp, Artificial Sequence
  Description of Artificial Sequence: Synthetic oligonucleotide
  Target: ATXN1; (-) strand; PAM type: NNNNGHTT; PAM sequence: TTTCGTTT
cgcttctggttcagggggac

SEQ ID NO: 30934 - DNA, 20 bp, Artificial Sequence
  Description of Artificial Sequence: Synthetic oligonucleotide
  Target: ATXN1; (-) strand; PAM type: NNNNGHTT; PAM sequence: ATTCGCTT
taactgagactgagttcaag

SEQ ID NO: 30935 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
caagctaactgagactgagt

SEQ ID NO: 30936 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
tggcctctactgaattatcc

SEQ ID NO: 30937 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
gaggtggaggttgcagtgag

SEQ ID NO: 30938 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
tcctcaaacatgtaagtcta

SEQ ID NO: 30939 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
aaacttcaattatatttgtc

SEQ ID NO: 30940 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
tatttcttgttttcctgctg

SEQ ID NO: 30941 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
cttcctcatggtcccttatt

SEQ ID NO: 30942 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
taaaacactcttaggaagtc

SEQ ID NO: 30943 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
tatgaatagaagcgggaaag

SEQ ID NO: 30944 - DNA, 20 bp, Artificial Sequence
  Description of Artificial Sequence: Synthetic oligonucleotide
  Target: ATXN1; (-) strand; PAM type: NNNNGHTT; PAM sequence: CCAGGTTT
tatgccagagcaactgtgag

SEQ ID NO: 30945 - DNA, 20 bp, Artificial Sequence
  Description of Artificial Sequence: Synthetic oligonucleotide
  Target: ATXN1; (-) strand; PAM type: NNNNGHTT; PAM sequence: CAAGGCTT
ccctggttggttttggcggt

SEQ ID NO: 30946 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
tagatctcatcaactccctg

SEQ ID NO: 30947 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
aagcaaaagatgccttttcg

SEQ ID NO: 30948 - DNA, 20 bp, Artificial Sequence
  Description of Artificial Sequence: Synthetic oligonucleotide
  Target: ATXN1; (-) strand; PAM type: NNNNGHTT; PAM sequence: GATTGATT
ccctaaacacaggaggaagt

SEQ ID NO: 30949 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
tgaaccctaaacacaggagg

SEQ ID NO: 30950 - DNA, 20 bp, Artificial Sequence
  Description of Artificial Sequence: Synthetic oligonucleotide
  Target: ATXN1; (-) strand; PAM type: NNNNGHTT; PAM sequence: TCTAGATT
gctagactgacatatggact

SEQ ID NO: 30951 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
tctttatcctaacagccaca

SEQ ID NO: 30952 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
attaaggagagttcagtgtc

SEQ ID NO: 30953 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
aaatttttctaatgaacatc

SEQ ID NO: 30954 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
tttaaggactcatatgaaag

SEQ ID NO: 30955 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
tgtttttaaggactcatatg

SEQ ID NO: 30956 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
aaagttacaaacagagcact

SEQ ID NO: 30957 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
cctccggcactagttgccaa

SEQ ID NO: 30958 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
agatgtgtgacctcaacccc

SEQ ID NO: 30959 - DNA, 20 bp, Artificial Sequence
  Description of Artificial Sequence: Synthetic oligonucleotide
  Target: ATXN1; (-) strand; PAM type: NNNNGHTT; PAM sequence: GCTGGATT
gccttcaagcgtgatcatgg

SEQ ID NO: 30960 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
gaaggtttgacaatagtccc

SEQ ID NO: 30961 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
gaaatatgtctgtatcccaa

SEQ ID NO: 30962 - DNA, 20 bp, Artificial Sequence
  Description of Artificial Sequence: Synthetic oligonucleotide
  Target: ATXN1; (-) strand; PAM type: NNNNGHTT; PAM sequence: TATGGATT
ctttaaaatgagaggagggt

SEQ ID NO: 30963 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
cttcagaccacttccgactc

SEQ ID NO: 30964 - DNA, 20 bp, Artificial Sequence
  Description of Artificial Sequence: Synthetic oligonucleotide
  Target: ATXN1; (-) strand; PAM type: NNNNGHTT; PAM sequence: AAGGGTTT
aggcctctgtggaattagcc

SEQ ID NO: 30965 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
ttatataagtggttttcaaa

SEQ ID NO: 30966 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
tgaggaagttgggttatata

SEQ ID NO: 30967 - DNA, 20 bp, Artificial Sequence
  Description of Artificial Sequence: Synthetic oligonucleotide
  Target: ATXN1; (-) strand; PAM type: NNNNGHTT; PAM sequence: TGAGGTTT
attagcagagagtaaatgat

SEQ ID NO: 30968 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
tatctctattagcagagagt

SEQ ID NO: 30969 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
ttcactcacttgtgcttctg

SEQ ID NO: 30970 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
aaaatttcactcacttgtgc

SEQ ID NO: 30971 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
ctaaagaaaatttcactcac

SEQ ID NO: 30972 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
caaaaatttacaatacactt

SEQ ID NO: 30973 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
agtttagcaaaatgcagttt

SEQ ID NO: 30974 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
atttttaaagtttagcaaaa

SEQ ID NO: 30975 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
tgggcaaaagccttcatttt

SEQ ID NO: 30976 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
atgtaagaagtcaactttaa

SEQ ID NO: 30977 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
agattctagcagggagtact

SEQ ID NO: 30978 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
gtaataataatattcttttc

SEQ ID NO: 30979 - DNA, 20 bp, Artificial Sequence
  Description of Artificial Sequence: Synthetic oligonucleotide
  Target: ATXN1; (-) strand; PAM type: NNNNGHTT; PAM sequence: GTTAGCTT
tttattacctgtaaacatgt

SEQ ID NO: 30980 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
actggttcctctgctccctg

SEQ ID NO: 30981 - DNA, 20 bp, Artificial Sequence
  Description of Artificial Sequence: Synthetic oligonucleotide
  Target: ATXN1; (-) strand; PAM type: NNNNGHTT; PAM sequence: CCCTGATT
taatgactggttcctctgct

SEQ ID NO: 30982 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
ttagagaacattttagtttt

SEQ ID NO: 30983 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
tgataatgcttagagaacat

SEQ ID NO: 30984 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
tatttttgtttaggacttga

SEQ ID NO: 30985 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tttgctttgtgaaattatat

SEQ ID NO: 30986 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
ttgaacgataaaatgaatgt

SEQ ID NO: 30987 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
tataccagtaaagctaaagt

SEQ ID NO: 30988 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
aagaatattcggtattaaga

SEQ ID NO: 30989 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
aatttaagactctgtgttat

SEQ ID NO: 30990 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
ttgtatattttagtatctga

SEQ ID NO: 30991 - DNA, 20 bp, Artificial Sequence
  Description of Artificial Sequence: Synthetic oligonucleotide
  Target: ATXN1; (-) strand; PAM type: NNNNGHTT; PAM sequence: ATCAGATT
tcactaattcacagtgcgtt

SEQ ID NO: 30992 - DNA, 20 bp, Artificial Sequence
  Description of Artificial Sequence: Synthetic oligonucleotide
  Target: ATXN1; (-) strand; PAM type: NNNNGHTT; PAM sequence: GATGGCTT
gtctcgtggaatattggatg

SEQ ID NO: 30993 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
tgaatatgttatttaatctt

SEQ ID NO: 30994 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
cttgaaatgctcttacggtt

SEQ ID NO: 30995 - DNA, 20 bp, Artificial Sequence
  Description of Artificial Sequence: Synthetic oligonucleotide
  Target: ATXN1; (-) strand; PAM type: NNNNGHTT; PAM sequence: TACGGTTT
atcttgccttgaaatgctct

SEQ ID NO: 30996 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
ggaggttctcagtaaatatt

SEQ ID NO: 30997 - DNA, 20 bp, Artificial Sequence
  Description of Artificial Sequence: Synthetic oligonucleotide
  Target: ATXN1; (-) strand; PAM type: NNNNGHTT; PAM sequence: CAAGGCTT
attaagattgtaattccatc

SEQ ID NO: 30998 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
gtgcactctgattgttccca

SEQ ID NO: 30999 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
tgagcatatggagtagtgca

SEQ ID NO: 31000 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
gtaattacatgccaatggct

SEQ ID NO: 31001 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
cctggttgtaattacatgcc

SEQ ID NO: 31002 - DNA, 20 bp, Artificial Sequence
  Description of Artificial Sequence: Synthetic oligonucleotide
  Target: ATXN1; (-) strand; PAM type: NNNNGHTT; PAM sequence: GACAGCTT
ttctcatatactagcaagca

SEQ ID NO: 31003 - DNA, 20 bp, Artificial Sequence
  Description of Artificial Sequence: Synthetic oligonucleotide
  Target: ATXN1; (-) strand; PAM type: NNNNGHTT; PAM sequence: ATAGGTTT
aggtttttcagatacattaa

SEQ ID NO: 31004 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
aagtttaattttggagagga

SEQ ID NO: 31005 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
attttctcatcacgaaagtc

SEQ ID NO: 31006 - DNA, 20 bp, Artificial Sequence
  Description of Artificial Sequence: Synthetic oligonucleotide
  Target: ATXN1; (-) strand; PAM type: NNNNGHTT; PAM sequence: CTTAGATT
gtaggtggtattagaagatt

SEQ ID NO: 31007 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
aggtgcatgtaggtggtatt

SEQ ID NO: 31008 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
tacattgtacttttcagagt

SEQ ID NO: 31009 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
tcttaatacattgtactttt

SEQ ID NO: 31010 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
ctcttgagcatgattttttt

SEQ ID NO: 31011 - DNA, 20 bp, Artificial Sequence
  Description of Artificial Sequence: Synthetic oligonucleotide
  Target: ATXN1; (-) strand; PAM type: NNNNGHTT; PAM sequence: GCATGATT
taatttcaaagggctcttga

SEQ ID NO: 31012 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
tgcggacacaaggcactttg

SEQ ID NO: 31013 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
cctcttgcggacacaaggca

SEQ ID NO: 31014 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
aactctgagtttaatctctc

SEQ ID NO: 31015 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
tctaaactttttctacaact

SEQ ID NO: 31016 - DNA, 20 bp, Artificial Sequence
  Description of Artificial Sequence: Synthetic oligonucleotide
  Target: ATXN1; (-) strand; PAM type: NNNNGHTT; PAM sequence: ATCCGTTT
tttttcctgcgaaattctaa

SEQ ID NO: 31017 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
ccaggctgcttatacgaaaa

SEQ ID NO: 31018 - DNA, 20 bp, Artificial Sequence
  Description of Artificial Sequence: Synthetic oligonucleotide
  Target: ATXN1; (-) strand; PAM type: NNNNGHTT; PAM sequence: GGCTGCTT
gtatttcttctttgattcca

SEQ ID NO: 31019 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
tgtgtgtgtgtgtatttctt

SEQ ID NO: 31020 - DNA, 20 bp, Artificial Sequence
  Description of Artificial Sequence: Synthetic oligonucleotide
  Target: ATXN1; (-) strand; PAM type: NNNNGHTT; PAM sequence: TACAGCTT
ttctggttgctatgatttta

SEQ ID NO: 31021 - DNA, 20 bp, Artificial Sequence
  Description of Artificial Sequence: Synthetic oligonucleotide
  Target: ATXN1; (-) strand; PAM type: NNNNGHTT; PAM sequence: CTATGATT
ttcctttagttttctggttg

SEQ ID NO: 31022 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
tgccagaggtgtttgtttcc

SEQ ID NO: 31023 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tgaggatttctgccagaggt

SEQ ID NO: 31024 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
ttggtgaggatttctgccag

SEQ ID NO: 31025 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
atgccttatactttgtttgg

SEQ ID NO: 31026 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
tagtttctttatgccttata

SEQ ID NO: 31027 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
ttaaaagtggccaatgaaag

SEQ ID NO: 31028 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
acaggagggccctccgtgaa

SEQ ID NO: 31029 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
ttctcatggaaattcatcaa

SEQ ID NO: 31030 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
cttttttgtttgtttagcag

SEQ ID NO: 31031 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tatcgcattagtcctttttt

SEQ ID NO: 31032 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cagatatcgcattagtcctt

SEQ ID NO: 31033 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
tcttcatttacttatatcaa

SEQ ID NO: 31034 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
cacttcagggctgtttcaac

SEQ ID NO: 31035 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
cattttttctgtcacttcag

SEQ ID NO: 31036 - DNA, 20 bp, Artificial Sequence
  Description of Artificial Sequence: Synthetic oligonucleotide
  Target: ATXN1; (-) strand; PAM type: NNNNGHTT; PAM sequence: TTGAGCTT
gtaccaccttgcctctggag

SEQ ID NO: 31037 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
aggtagagaccctcaactag

SEQ ID NO: 31038 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
ctatggagaaagccaaagtt

SEQ ID NO: 31039 - DNA, 20 bp, Artificial Sequence
  Description of Artificial Sequence: Synthetic oligonucleotide
  Target: ATXN1; (-) strand; PAM type: NNNNGHTT; PAM sequence: TACAGCTT
attttccaccaacaggatgt

SEQ ID NO: 31040 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
ctttgcacaattaccctgtt

SEQ ID NO: 31041 - DNA, 20 bp, Artificial Sequence
  Description of Artificial Sequence: Synthetic oligonucleotide
  Target: ATXN1; (-) strand; PAM type: NNNNGHTT; PAM sequence: CCCTGTTT
attctctctttgcacaatta

SEQ ID NO: 31042 - DNA, 20 bp, Artificial Sequence
  Description of Artificial Sequence: Synthetic oligonucleotide
  Target: ATXN1; (-) strand; PAM type: NNNNGHTT; PAM sequence: AGCAGATT
aaataagtgagccgggtaaa

SEQ ID NO: 31043 - DNA, 20 bp, Artificial Sequence
  Description of Artificial Sequence: Synthetic oligonucleotide
  Target: ATXN1; (-) strand; PAM type: NNNNGHTT; PAM sequence: GGTAGTTT
atttcacaaaatagtttatt

SEQ ID NO: 31044 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
tactaaacttgatttcacaa

SEQ ID NO: 31045 - DNA, 20 bp, Artificial Sequence
  Description of Artificial Sequence: Synthetic oligonucleotide
  Target: ATXN1; (-) strand; PAM type: NNNNGHTT; PAM sequence: ACTTGATT
tgagaatctcaagttactaa

SEQ ID NO: 31046 - DNA, 20 bp, Artificial Sequence
  Description of Artificial Sequence: Synthetic oligonucleotide
  Target: ATXN1; (-) strand; PAM type: NNNNGHTT; PAM sequence: TCAGGTTT
caaaggagagagatgtctaa

SEQ ID NO: 31047 - DNA, 20 bp, Artificial Sequence
  Description of Artificial Sequence: Synthetic oligonucleotide
  Target: ATXN1; (-) strand; PAM type: NNNNGHTT; PAM sequence: CCATGCTT
atgcatctccaagtctattt

SEQ ID NO: 31048 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
tgctgcatataggaaaagca

SEQ ID NO: 31049 - DNA, 20 bp, Artificial Sequence
  Description of Artificial Sequence: Synthetic oligonucleotide
  Target: ATXN1; (-) strand; PAM type: NNNNGHTT; PAM sequence: ACTTGCTT
acaacagtcccagaccccag

SEQ ID NO: 31050 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgggaggatcccatgggccc

SEQ ID NO: 31051 - DNA, 20 bp, Artificial Sequence
  Description of Artificial Sequence: Synthetic oligonucleotide
  Target: ATXN1; (-) strand; PAM type: NNNNGHTT; PAM sequence: AGCAGCTT
cttgagcccaggagtttgac

SEQ ID NO: 31052 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgggaggatcccttgagccc

SEQ ID NO: 31053 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
gtgaggtgatggacatatta

SEQ ID NO: 31054 - DNA, 20 bp, Artificial Sequence
  Description of Artificial Sequence: Synthetic oligonucleotide
  Target: ATXN1; (-) strand; PAM type: NNNNGHTT; PAM sequence: ATACGTTT
atgtcaagattgctaaaaga

SEQ ID NO: 31055 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
ataataaggtattataaatg

SEQ ID NO: 31056 - DNA, 20 bp, Artificial Sequence
  Description of Artificial Sequence: Synthetic oligonucleotide
  Target: ATXN1; (-) strand; PAM type: NNNNGHTT; PAM sequence: ACAGGATT
aagtttctgagacccattgt

SEQ ID NO: 31057 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
gtttcagttagacaagaggg

SEQ ID NO: 31058 - DNA, 20 bp, Artificial Sequence
  Description of Artificial Sequence: Synthetic oligonucleotide
  Target: ATXN1; (-) strand; PAM type: NNNNGHTT; PAM sequence: AGACGTTT
tttggttgatcaaacggtac

SEQ ID NO: 31059 - DNA, 20 bp, Artificial Sequence
  Description of Artificial Sequence: Synthetic oligonucleotide
  Target: ATXN1; (-) strand; PAM type: NNNNGHTT; PAM sequence: TCTGGCTT
tttgtttcatcttcctctat

SEQ ID NO: 31060 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tcccttcagaatcctgagtg

SEQ ID NO: 31061 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
gtgttcccttcagaatcctg

SEQ ID NO: 31062 - DNA, 20 bp, Artificial Sequence
  Description of Artificial Sequence: Synthetic oligonucleotide
  Target: ATXN1; (-) strand; PAM type: NNNNGHTT; PAM sequence: TGAAGATT
ttgctgatagagtggagagc

SEQ ID NO: 31063 - DNA, 20 bp, Artificial Sequence
  Description of Artificial Sequence: Synthetic oligonucleotide
  Target: ATXN1; (-) strand; PAM type: NNNNGHTT; PAM sequence: CACTGCTT
caatgtgttgggacttctaa

SEQ ID NO: 31064 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
attttccaattatcctctcc

SEQ ID NO: 31065 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
gcctctgccaatctacaatt

SEQ ID NO: 31066 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
attagtagaagtcgaaatag

SEQ ID NO: 31067 - DNA, 20 bp, Artificial Sequence
  Description of Artificial Sequence: Synthetic oligonucleotide
  Target: ATXN1; (-) strand; PAM type: NNNNGHTT; PAM sequence: CTCCGTTT
gtcactctccctctttccac

SEQ ID NO: 31068 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
ctttatgaaggggattggag

SEQ ID NO: 31069 - DNA, 20 bp, Artificial Sequence
  Description of Artificial Sequence: Synthetic oligonucleotide
  Target: ATXN1; (-) strand; PAM type: NNNNGHTT; PAM sequence: AGGGGATT
agcatcatcgtgctttatga

SEQ ID NO: 31070 - DNA, 20 bp, Artificial Sequence
  Description of Artificial Sequence: Synthetic oligonucleotide
  Target: ATXN1; (-) strand; PAM type: NNNNGHTT; PAM sequence: TCGTGCTT
gttgtgtttgaacagcatca

SEQ ID NO: 31071 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
ctaaggacaggaggcacagg

SEQ ID NO: 31072 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
tttgtctcattctcagtttt

SEQ ID NO: 31073 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
ctttcttcctttgtctcatt

SEQ ID NO: 31074 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
tgattgcaaacactacaata

SEQ ID NO: 31075 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
aatgtaatgaaaggcacaag

SEQ ID NO: 31076 - DNA, 20 bp, Artificial Sequence
  Description of Artificial Sequence: Synthetic oligonucleotide
  Target: ATXN1; (-) strand; PAM type: NNNNGHTT; PAM sequence: ACCTGATT
ggagcaaataatgatttggg

SEQ ID NO: 31077 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
acaatgataaaaggagcaaa

SEQ ID NO: 31078 - DNA, 20 bp, Artificial Sequence
  Description of Artificial Sequence: Synthetic oligonucleotide
  Target: ATXN1; (-) strand; PAM type: NNNNGHTT; PAM sequence: GGGAGCTT
agacagagctcctcccctca

SEQ ID NO: 31079 - DNA, 20 bp, Artificial Sequence
  Description of Artificial Sequence: Synthetic oligonucleotide
  Target: ATXN1; (-) strand; PAM type: NNNNGHTT; PAM sequence: CTTAGCTT
cagcctttcagtaaatttta

SEQ ID NO: 31080 - DNA, 20 bp, Artificial Sequence
  Description of Artificial Sequence: Synthetic oligonucleotide
  Target: ATXN1; (-) strand; PAM type: NNNNGHTT; PAM sequence: GGAAGTTT
atttcttcttcattccatgt

SEQ ID NO: 31081 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
aaaaactctcaatcttttaa

SEQ ID NO: 31082 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
gctttccatttttaacatac

SEQ ID NO: 31083 - DNA, 20 bp, Artificial Sequence
  Description of Artificial Sequence: Synthetic oligonucleotide
  Target: ATXN1; (-) strand; PAM type: NNNNGHTT; PAM sequence: AGGTGCTT
actgacagtaacagcttaat

SEQ ID NO: 31084 - DNA, 20 bp, Artificial Sequence
  Description of Artificial Sequence: Synthetic oligonucleotide
  Target: ATXN1; (-) strand; PAM type: NNNNGHTT; PAM sequence: AACAGCTT
taacaggtgaaactgacagt

SEQ ID NO: 31085 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
ctttgcaactcaggaactat

SEQ ID NO: 31086 - DNA, 20 bp, Artificial Sequence
  Description of Artificial Sequence: Synthetic oligonucleotide
  Target: ATXN1; (-) strand; PAM type: NNNNGHTT; PAM sequence: ATATGCTT
gacattgtacttcagcctgt

SEQ ID NO: 31087 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
tatttatttaccacccttta

SEQ ID NO: 31088 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
cttccatttatttcaactac

SEQ ID NO: 31089 - DNA, 20 bp, Artificial Sequence
  Description of Artificial Sequence: Synthetic oligonucleotide
  Target: ATXN1; (-) strand; PAM type: NNNNGHTT; PAM sequence: TAGAGCTT
ctgtctgtccacacactgcc

SEQ ID NO: 31090 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
taatactatcacgtggggag

SEQ ID NO: 31091 - DNA, 20 bp, Artificial Sequence
  Description of Artificial Sequence: Synthetic oligonucleotide
  Target: ATXN1; (-) strand; PAM type: NNNNGHTT; PAM sequence: TAAGGCTT
ccaccacacccggcctattc

SEQ ID NO: 31092 - DNA, 20 bp, Artificial Sequence
  Description of Artificial Sequence: Synthetic oligonucleotide
  Target: ATXN1; (-) strand; PAM type: NNNNGHTT; PAM sequence: ACAGGCTT
cctcccaaagtgctgggatt

SEQ ID NO: 31093 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgcctcggcctcccaaagtg

SEQ ID NO: 31094 - DNA, 20 bp, Artificial Sequence
  Description of Artificial Sequence: Synthetic oligonucleotide
  Target: ATXN1; (-) strand; PAM type: NNNNGHTT; PAM sequence: TGAGGTTT
cggtgtatttttagtagaga

SEQ ID NO: 31095 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
tgtttacttcaatggttaca

SEQ ID NO: 31096 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
gaatttaaaagcacaaagaa

SEQ ID NO: 31097 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
tgtgatatggctgctaaggt

SEQ ID NO: 31098 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
ctgagaacccaaagtaatca

SEQ ID NO: 31099 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
gtctttaaaatagacaaatc

SEQ ID NO: 31100 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
acaatggccaaaattatatg

SEQ ID NO: 31101 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
atgttttagaaagtggttgc

SEQ ID NO: 31102 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
cactgcttattccttagcct

SEQ ID NO: 31103 - DNA, 20 bp, Artificial Sequence
  Description of Artificial Sequence: Synthetic oligonucleotide
  Target: ATXN1; (-) strand; PAM type: NNNNGHTT; PAM sequence: CACTGCTT
tacaggtaaagtgcccagca

SEQ ID NO: 31104 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gcccattacttagcctgagc

SEQ ID NO: 31105 - DNA, 20 bp, Artificial Sequence
  Description of Artificial Sequence: Synthetic oligonucleotide
  Target: ATXN1; (-) strand; PAM type: NNNNGHTT; PAM sequence: CTGAGCTT
tcttgggcccattacttagc

SEQ ID NO: 31106 - DNA, 20 bp, Artificial Sequence
  Description of Artificial Sequence: Synthetic oligonucleotide
  Target: ATXN1; (-) strand; PAM type: NNNNGHTT; PAM sequence: TAAGGTTT
aggtctgggctcgttctgac

SEQ ID NO: 31107 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
cactgagcttaagtagagga

SEQ ID NO: 31108 - DNA, 20 bp, Artificial Sequence
  Description of Artificial Sequence: Synthetic oligonucleotide
  Target: ATXN1; (-) strand; PAM type: NNNNGHTT; PAM sequence: CTGAGCTT
ctactcagtgtacagataca

SEQ ID NO: 31109 - DNA, 20 bp, Artificial Sequence
  Description of Artificial Sequence: Synthetic oligonucleotide
  Target: ATXN1; (-) strand; PAM type: NNNNGHTT; PAM sequence: TAGAGCTT
gcggagctgaaatctgaact

SEQ ID NO: 31110 - DNA, 20 bp, Artificial Sequence
  Description of Artificial Sequence: Synthetic oligonucleotide
  Target: ATXN1; (-) strand; PAM type: NNNNGHTT; PAM sequence: TTACGATT
tatcagttcttctggtacta

SEQ ID NO: 31111 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
gatgaggacagtggagctca

SEQ ID NO: 31112 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
cacataccttgtcttccatt

SEQ ID NO: 31113 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
ctttcacataccttgtcttc

SEQ ID NO: 31114 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
acatggtatatatagcactt

SEQ ID NO: 31115 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
atggaatagagattgacctc

SEQ ID NO: 31116 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
tcaggcaggagagaatggaa

SEQ ID NO: 31117 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
cagtgtccaggttttggaac

SEQ ID NO: 31118 - DNA, 20 bp, Artificial Sequence
  Description of Artificial Sequence: Synthetic oligonucleotide
  Target: ATXN1; (-) strand; PAM type: NNNNGHTT; PAM sequence: CCAGGTTT
tatgattagcagttcagtgt

SEQ ID NO: 31119 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
gtgactggacatgtgttctg

SEQ ID NO: 31120 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
gaaggaggtagttaatagag

SEQ ID NO: 31121 - DNA, 20 bp, Artificial Sequence
  Description of Artificial Sequence: Synthetic oligonucleotide
  Target: ATXN1; (-) strand; PAM type: NNNNGHTT; PAM sequence: GAGTGCTT
gaaggtacttcagagtcttg

SEQ ID NO: 31122 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
gagagcctgtgacttactct

SEQ ID NO: 31123 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
ctgggggtggactggtgagg

SEQ ID NO: 31124 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
tataattagtgtgtcggaat

SEQ ID NO: 31125 - DNA, 20 bp, Artificial Sequence
  Description of Artificial Sequence: Synthetic oligonucleotide
  Target: ATXN1; (-) strand; PAM type: NNNNGHTT; PAM sequence: TGAAGATT
ttctgcacattagtgatcct

SEQ ID NO: 31126 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
agattaaatttttcattgtt

SEQ ID NO: 31127 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
cttaggtagattaaattttt

SEQ ID NO: 31128 - DNA, 20 bp, Artificial Sequence
  Description of Artificial Sequence: Synthetic oligonucleotide
  Target: ATXN1; (-) strand; PAM type: NNNNGHTT; PAM sequence: GGTAGATT
tgaaacatgtaggcatctta

SEQ ID NO: 31129 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
agcataatactaacttactc

SEQ ID NO: 31130 - DNA, 20 bp, Artificial Sequence
  Description of Artificial Sequence: Synthetic oligonucleotide
  Target: ATXN1; (-) strand; PAM type: NNNNGHTT; PAM sequence: CGGAGCTT
ttgctagaaccaggaggcgg

SEQ ID NO: 31131 - DNA, 20 bp, Artificial Sequence
  Description of Artificial Sequence: Synthetic oligonucleotide
  Target: ATXN1; (-) strand; PAM type: NNNNGHTT; PAM sequence: TACGGTTT
ctgtgcttttacaaccataa

SEQ ID NO: 31132 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
aatttaaacaaagtaaataa

SEQ ID NO: 31133 - DNA, 20 bp, Artificial Sequence
  Description of Artificial Sequence: Synthetic oligonucleotide
  Target: ATXN1; (-) strand; PAM type: NNNNGHTT; PAM sequence: CCCAGTTT
cttaaggctgacgtgtgttt

SEQ ID NO: 31134 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
atgtagtccttaaggctgac

SEQ ID NO: 31135 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
gaaggttattgtagacgacc

SEQ ID NO: 31136 - DNA, 20 bp, Artificial Sequence
  Description of Artificial Sequence: Synthetic oligonucleotide
  Target: ATXN1; (-) strand; PAM type: NNNNGHTT; PAM sequence: GATTGATT
gtctaaaaatggaacaagct

SEQ ID NO: 31137 - DNA, 20 bp, Artificial Sequence
  Description of Artificial Sequence: Synthetic oligonucleotide
  Target: ATXN1; (-) strand; PAM type: NNNNGHTT; PAM sequence: AGCTGATT
gactgtctaaaaatggaaca

SEQ ID NO: 31138 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
ttttcagaaagattgtaagt

SEQ ID NO: 31139 - DNA, 20 bp, Artificial Sequence
  Description of Artificial Sequence: Synthetic oligonucleotide
  Target: ATXN1; (-) strand; PAM type: NNNNGHTT; PAM sequence: GAAAGATT
tttataatgtatccttttca

SEQ ID NO: 31140 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
ttacgccttgtttctcatga

SEQ ID NO: 31141 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
agacagagtgataaattacg

SEQ ID NO: 31142 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
aacactgacttggctcataa

SEQ ID NO: 31143 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
aggtttgccagctctgctac

SEQ ID NO: 31144 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
gaggtagtcatctggatact

SEQ ID NO: 31145 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
gagatgatgacctgttcatc

SEQ ID NO: 31146 - DNA, 20 bp, Artificial Sequence
  Description of Artificial Sequence: Synthetic oligonucleotide
  Target: ATXN1; (-) strand; PAM type: NNNNGHTT; PAM sequence: GCTTGCTT
ttgtcccacacacctggtgg

SEQ ID NO: 31147 - DNA, 20 bp, Artificial Sequence
  Description of Artificial Sequence: Synthetic oligonucleotide
  Target: ATXN1; (-) strand; PAM type: NNNNGHTT; PAM sequence: GTGGGCTT
agaattgtcccacacacctg

SEQ ID NO: 31148 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
ccattgcccaggctgcattt

SEQ ID NO: 31149 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cttgtgcgaccacacttatt

SEQ ID NO: 31150 - DNA, 20 bp, Artificial Sequence
  Description of Artificial Sequence: Synthetic oligonucleotide
  Target: ATXN1; (-) strand; PAM type: NNNNGHTT; PAM sequence: AACTGCTT
attttgtagactcctgaaat

SEQ ID NO: 31151 - DNA, 20 bp, Artificial Sequence
  Description of Artificial Sequence: Synthetic oligonucleotide
  Target: ATXN1; (-) strand; PAM type: NNNNGHTT; PAM sequence: TAAAGATT
ttacttccatatttctctag

SEQ ID NO: 31152 - DNA, 20 bp, Artificial Sequence
  Description of Artificial Sequence: Synthetic oligonucleotide
  Target: ATXN1; (-) strand; PAM type: NNNNGHTT; PAM sequence: CAATGATT
cgtaattcttaagagttcct

SEQ ID NO: 31153 - DNA, 20 bp, Artificial Sequence
  Description of Artificial Sequence: Synthetic oligonucleotide
  Target: ATXN1; (-) strand; PAM type: NNNNGHTT; PAM sequence: AGGGGCTT
tctcaggtcgcctaagctgg

SEQ ID NO: 31154 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
cttttccactattctgaaaa

SEQ ID NO: 31155 - DNA, 20 bp, Artificial Sequence
  Description of Artificial Sequence: Synthetic oligonucleotide
  Target: ATXN1; (-) strand; PAM type: NNNNGHTT; PAM sequence: CTTAGCTT
cacatctagtcttttcctct

SEQ ID NO: 31156 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
ttagagaaagaagagtcgag

SEQ ID NO: 31157 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
aactcttactgatggaacta

SEQ ID NO: 31158 - DNA, 20 bp, Artificial Sequence
  Description of Artificial Sequence: Synthetic oligonucleotide
  Target: ATXN1; (-) strand; PAM type: NNNNGHTT; PAM sequence: CAACGCTT
aaagagtgagcaagcctcgc

SEQ ID NO: 31159 - DNA, 20 bp, Artificial Sequence
  Description of Artificial Sequence: Synthetic oligonucleotide
  Target: ATXN1; (-) strand; PAM type: NNNNGHTT; PAM sequence: TGGCGTTT
ctctgttactagctccactg

SEQ ID NO: 31160 - DNA, 20 bp, Artificial Sequence
  Description of Artificial Sequence: Synthetic oligonucleotide
  Target: ATXN1; (-) strand; PAM type: NNNNGHTT; PAM sequence: ATAAGTTT
tagttgaagaagtggaaatt

SEQ ID NO: 31161 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tctaaatggcgtctccttaa

SEQ ID NO: 31162 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
agtggaaagaagaaaagccc

SEQ ID NO: 31163 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
cagagagcactgggtgggaa

SEQ ID NO: 31164 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
gggattaagcccagtgagag

SEQ ID NO: 31165 - DNA, 20 bp, Artificial Sequence
  Description of Artificial Sequence: Synthetic oligonucleotide
  Target: ATXN1; (-) strand; PAM type: NNNNGHTT; PAM sequence: TGGGGATT
atgagtcaattaaaaacatt

SEQ ID NO: 31166 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
ttaaaatactcagaaggaag

SEQ ID NO: 31167 - DNA, 20 bp, Artificial Sequence
  Description of Artificial Sequence: Synthetic oligonucleotide
  Target: ATXN1; (-) strand; PAM type: NNNNGHTT; PAM sequence: AAGAGTTT
tccatgtttggctttgttag

SEQ ID NO: 31168 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
gtaacgctgtttaatccatg

SEQ ID NO: 31169 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
cttatgtaacgctgtttaat

SEQ ID NO: 31170 - DNA, 20 bp, Artificial Sequence
  Description of Artificial Sequence: Synthetic oligonucleotide
  Target: ATXN1; (-) strand; PAM type: NNNNGHTT; PAM sequence: CGCTGTTT
ctgtgaagagacttatgtaa

SEQ ID NO: 31171 - DNA, 20 bp, Artificial Sequence
  Description of Artificial Sequence: Synthetic oligonucleotide
  Target: ATXN1; (-) strand; PAM type: NNNNGHTT; PAM sequence: ACTTGATT
atgtcccattggttattggg

SEQ ID NO: 31172 - DNA, 20 bp, Artificial Sequence
  Description of Artificial Sequence: Synthetic oligonucleotide
  Target: ATXN1; (-) strand; PAM type: NNNNGHTT; PAM sequence: GGCAGCTT
ggcctcttcctagtcgatgg

SEQ ID NO: 31173 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
cctcattctgctctctgggg

SEQ ID NO: 31174 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
atatgtctgcagagcagtgg

SEQ ID NO: 31175 - DNA, 20 bp, Artificial Sequence
  Description of Artificial Sequence: Synthetic oligonucleotide
  Target: ATXN1; (-) strand; PAM type: NNNNGHTT; PAM sequence: GGATGATT
tcttgctgcgccattagaag

SEQ ID NO: 31176 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
agacttgaaggttctttagg

SEQ ID NO: 31177 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
cagtcactaatgatagagtg

SEQ ID NO: 31178 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
ctgctctaaagaaaattcat

SEQ ID NO: 31179 - DNA, 20 bp, Artificial Sequence
  Description of Artificial Sequence: Synthetic oligonucleotide
  Target: ATXN1; (-) strand; PAM type: NNNNGHTT; PAM sequence: CTAAGCTT
agtgcagtgttgtattaagt

SEQ ID NO: 31180 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tccactttagcaaaaggttt

SEQ ID NO: 31181 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
tgttttaatccactttagca

SEQ ID NO: 31182 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
catgtgtgccgtagctgttg

SEQ ID NO: 31183 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
gaacagtttctctgttaact

SEQ ID NO: 31184 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
aatcattctcatacttcaag

SEQ ID NO: 31185 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
tccttcattggtcatgtctt

SEQ ID NO: 31186 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
cagactccagactcctaatt

SEQ ID NO: 31187 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
actcctacaacacacagcct

SEQ ID NO: 31188 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
gaccactcctacaacacaca

SEQ ID NO: 31189 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
aattttacagaggaaacatt

SEQ ID NO: 31190 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
tcgtagaattttaaagctta

SEQ ID NO: 31191 - DNA, 20 bp, Artificial Sequence
  Description of Artificial Sequence: Synthetic oligonucleotide
  Target: ATXN1; (-) strand; PAM type: NNNNGHTT; PAM sequence: TAAAGCTT
gacggacaatcgtagaattt

SEQ ID NO: 31192 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
aaaaagcaggtattattaaa

SEQ ID NO: 31193 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
gattttctgccttttaaaaa

SEQ ID NO: 31194 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
acattttttattcttttctg

SEQ ID NO: 31195 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
agcagatactgatttctgga

SEQ ID NO: 31196 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
tttttctttggaagagcaga

SEQ ID NO: 31197 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
actgtagccccacatttatt

SEQ ID NO: 31198 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
agtttaatagtgagtaatag

SEQ ID NO: 31199 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
tgtttttgtaggttttgaaa

SEQ ID NO: 31200 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
ttaattttggagctgttttt

SEQ ID NO: 31201 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
ttttgctggcttaattttgg

SEQ ID NO: 31202 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
atggatgacagcaacatttt

SEQ ID NO: 31203 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
tcaaagattctatgacgagc

SEQ ID NO: 31204 - DNA, 20 bp, Artificial Sequence
  Description of Artificial Sequence: Synthetic oligonucleotide
  Target: ATXN1; (-) strand; PAM type: NNNNGHTT; PAM sequence: ACGAGCTT
gtgaggtcaaagattctatg

SEQ ID NO: 31205 - DNA, 20 bp, Artificial Sequence
  Description of Artificial Sequence: Synthetic oligonucleotide
  Target: ATXN1; (-) strand; PAM type: NNNNGHTT; PAM sequence: CAAAGATT
aaaacattgaatggtgaggt

SEQ ID NO: 31206 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
ctagctctgaattcagccgg

SEQ ID NO: 31207 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
tctttttactatgacccaca

SEQ ID NO: 31208 - DNA, 20 bp, Artificial Sequence
  Description of Artificial Sequence: Synthetic oligonucleotide
  Target: ATXN1; (-) strand; PAM type: NNNNGHTT; PAM sequence: GTTGGCTT
tgctggctcatgcagtgtag

SEQ ID NO: 31209 - DNA, 20 bp, Artificial Sequence
  Description of Artificial Sequence: Synthetic oligonucleotide
  Target: ATXN1; (-) strand; PAM type: NNNNGHTT; PAM sequence: AAGTGCTT
ggtcttacgttaataaaaac

SEQ ID NO: 31210 - DNA, 20 bp, Artificial Sequence
  Description of Artificial Sequence: Synthetic oligonucleotide
  Target: ATXN1; (-) strand; PAM type: NNNNGHTT; PAM sequence: AGTTGATT
gtttttcttctaagggacac

SEQ ID NO: 31211 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
cacgattatcactgaatttg

SEQ ID NO: 31212 - DNA, 20 bp, Artificial Sequence
  Description of Artificial Sequence: Synthetic oligonucleotide
  Target: ATXN1; (-) strand; PAM type: NNNNGHTT; PAM sequence: CCACGATT
atttggtcaaaaagaatggc

SEQ ID NO: 31213 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
ttttttaaaactctgtactg

SEQ ID NO: 31214 - DNA, 20 bp, Artificial Sequence
  Description of Artificial Sequence: Synthetic oligonucleotide
  Target: ATXN1; (-) strand; PAM type: NNNNGHTT; PAM sequence: AGCGGATT
aagtagtgtgtttcatcctg

SEQ ID NO: 31215 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
cattcagtttattttaagta

SEQ ID NO: 31216 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gcggatcattttaggtgtca

SEQ ID NO: 31217 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
tagtttattttgtgacttgg

SEQ ID NO: 31218 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
gtaagcttccatggcttaat

SEQ ID NO: 31219 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
gagaatacagagtaagcttc

SEQ ID NO: 31220 - DNA, 20 bp, Artificial Sequence
  Description of Artificial Sequence: Synthetic oligonucleotide
  Target: ATXN1; (-) strand; PAM type: NNNNGHTT; PAM sequence: GTAAGCTT
aaggagagtgagaatacaga

SEQ ID NO: 31221 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
aagcacaaactgcctaccac

SEQ ID NO: 31222 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
tttaattgggaaagcattat

SEQ ID NO: 31223 - DNA, 20 bp, Artificial Sequence
  Description of Artificial Sequence: Synthetic oligonucleotide
  Target: ATXN1; (-) strand; PAM type: NNNNGHTT; PAM sequence: CCAGGATT
agggccggtcctggaagacc

SEQ ID NO: 31224 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
ccaaagagcctgtccagatc

SEQ ID NO: 31225 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
ttcagcagctatctcaggac

SEQ ID NO: 31226 - DNA, 20 bp, Artificial Sequence
  Description of Artificial Sequence: Synthetic oligonucleotide
  Target: ATXN1; (-) strand; PAM type: NNNNGHTT; PAM sequence: CCAGGATT
ttgtgctgctctgtaaatgg

SEQ ID NO: 31227 - DNA, 20 bp, Artificial Sequence
  Description of Artificial Sequence: Synthetic oligonucleotide
  Target: ATXN1; (-) strand; PAM type: NNNNGHTT; PAM sequence: ACTAGTTT
gcggcaggaaaaggaacagg

SEQ ID NO: 31228 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
aggaggctgaagctggggta

SEQ ID NO: 31229 - DNA, 20 bp, Artificial Sequence
  Description of Artificial Sequence: Synthetic oligonucleotide
  Target: ATXN1; (-) strand; PAM type: NNNNGHTT; PAM sequence: CCACGTTT
cagttttcacctcctcctgc

SEQ ID NO: 31230 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
ctcctcaattcccatcggtg

SEQ ID NO: 31231 - DNA, 20 bp, Artificial Sequence
  Description of Artificial Sequence: Synthetic oligonucleotide
  Target: ATXN1; (-) strand; PAM type: NNNNGHTT; PAM sequence: GTCTGCTT
ctagcagctaaaagcagcac

SEQ ID NO: 31232 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
ggtttctttttcttcttaag

SEQ ID NO: 31233 - DNA, 20 bp, Artificial Sequence
  Description of Artificial Sequence: Synthetic oligonucleotide
  Target: ATXN1; (-) strand; PAM type: NNNNGHTT; PAM sequence: GCTGGTTT
tgtcccatgttgggttttta

SEQ ID NO: 31234 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
gtgatagtaattgtcccatg

SEQ ID NO: 31235 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
gagtttaaaggtgctaaaac

SEQ ID NO: 31236 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
tgctggttcacggttcattc

SEQ ID NO: 31237 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tttttgttttttttttttcc

SEQ ID NO: 31238 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
atacccaggaggtcgctgct

SEQ ID NO: 31239 - DNA, 20 bp, Artificial Sequence
  Description of Artificial Sequence: Synthetic oligonucleotide
  Target: ATXN1; (-) strand; PAM type: NNNNGHTT; PAM sequence: CGCTGCTT
tattaccatacccaggaggt

SEQ ID NO: 31240 - DNA, 20 bp, Artificial Sequence
  Description of Artificial Sequence: Synthetic oligonucleotide
  Target: ATXN1; (-) strand; PAM type: NNNNGHTT; PAM sequence: CCTCGCTT
tgccaacatcccctcccaaa

SEQ ID NO: 31241 - DNA, 20 bp, Artificial Sequence
  Description of Artificial Sequence: Synthetic oligonucleotide
  Target: ATXN1; (-) strand; PAM type: NNNNGHTT; PAM sequence: TAGGGTTT
cacaacacgtatgccattcc

SEQ ID NO: 31242 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
aatggcatcttcaaatagga

SEQ ID NO: 31243 - DNA, 20 bp, Artificial Sequence
  Description of Artificial Sequence: Synthetic oligonucleotide
  Target: ATXN1; (-) strand; PAM type: NNNNGHTT; PAM sequence: TGTAGTTT
ttcctctgtctctttctttg

SEQ ID NO: 31244 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
tgtgtcataaaaaattcatt

SEQ ID NO: 31245 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
attccctgggctagtctgtt

SEQ ID NO: 31246 - DNA, 20 bp, Artificial Sequence
  Description of Artificial Sequence: Synthetic oligonucleotide
  Target: ATXN1; (-) strand; PAM type: NNNNGHTT; PAM sequence: CCATGCTT
cttgcttagctggacagtgg

SEQ ID NO: 31247 - DNA, 20 bp, Artificial Sequence
  Description of Artificial Sequence: Synthetic oligonucleotide
  Target: ATXN1; (-) strand; PAM type: NNNNGHTT; PAM sequence: GCTTGCTT
aatggccaaaagggttaatg

SEQ ID NO: 31248 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
agtgaatggccaaaagggtt

SEQ ID NO: 31249 - DNA, 20 bp, Artificial Sequence
  Description of Artificial Sequence: Synthetic oligonucleotide
  Target: ATXN1; (-) strand; PAM type: NNNNGHTT; PAM sequence: CCCCGTTT
actccttctccccttctctg

SEQ ID NO: 31250 - DNA, 20 bp, Artificial Sequence
  Description of Artificial Sequence: Synthetic oligonucleotide
  Target: ATXN1; (-) strand; PAM type: NNNNGHTT; PAM sequence: GCCTGATT
actctttatttccttctcct

SEQ ID NO: 31251 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ggagatttgggctgagacaa

SEQ ID NO: 31252 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
tgacgttgcttatcagctta

SEQ ID NO: 31253 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
agactttgctgacgttgctt

SEQ ID NO: 31254 - DNA, 20 bp, Artificial Sequence
  Description of Artificial Sequence: Synthetic oligonucleotide
  Target: ATXN1; (-) strand; PAM type: NNNNGHTT; PAM sequence: CGTTGCTT
gtatcctcagactttgctga

SEQ ID NO: 31255 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
gaatgcttgtgatttttgca

SEQ ID NO: 31256 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
ttagtggtgtataagaatgc

SEQ ID NO: 31257 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
tgtctgttagtggtgtataa

SEQ ID NO: 31258 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
aggtcactcatgatttggct

SEQ ID NO: 31259 - DNA, 20 bp, Artificial Sequence
  Description of Artificial Sequence: Synthetic oligonucleotide
  Target: ATXN1; (-) strand; PAM type: NNNNGHTT; PAM sequence: TCATGATT
agttgtgaataggaggtcac

SEQ ID NO: 31260 - DNA, 20 bp, Artificial Sequence
  Description of Artificial Sequence: Synthetic oligonucleotide
  Target: ATXN1; (-) strand; PAM type: NNNNGHTT; PAM sequence: GTTGGATT
gttcttcacatcccttgtaa

SEQ ID NO: 31261 - DNA, 20 bp, Artificial Sequence
  Description of Artificial Sequence: Synthetic oligonucleotide
  Target: ATXN1; (-) strand; PAM type: NNNNGHTT; PAM sequence: AGTGGTTT
cctcttttatttcgttgagc

SEQ ID NO: 31262 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tgagcatggaatgttcttcc

SEQ ID NO: 31263 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
cagtatggccattttgacga

SEQ ID NO: 31264 - DNA, 20 bp, Artificial Sequence
  Description of Artificial Sequence: Synthetic oligonucleotide
  Target: ATXN1; (-) strand; PAM type: NNNNGHTT; PAM sequence: GGTAGCTT
attctgtgaagaaagtcatt

SEQ ID NO: 31265 - DNA, 20 bp, Artificial Sequence
  Description of Artificial Sequence: Synthetic oligonucleotide
  Target: ATXN1; (-) strand; PAM type: NNNNGHTT; PAM sequence: AGTAGTTT
tggttccatatgaactttaa

SEQ ID NO: 31266 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
tccagctttgttcttttggc

SEQ ID NO: 31267 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
gatgcctccagctttgttct

SEQ ID NO: 31268 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
aagtcaggtagtgtgatgcc

SEQ ID NO: 31269 - DNA, 20 bp, Artificial Sequence
  Description of Artificial Sequence: Synthetic oligonucleotide
  Target: ATXN1; (-) strand; PAM type: NNNNGHTT; PAM sequence: TATAGTTT
tgattactgtagccttgtag

SEQ ID NO: 31270 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
ttggtaccagtaccatgctg

SEQ ID NO: 31271 - DNA, 20 bp, Artificial Sequence
  Description of Artificial Sequence: Synthetic oligonucleotide
  Target: ATXN1; (-) strand; PAM type: NNNNGHTT; PAM sequence: TGCTGTTT
ctgttttggtaccagtacca

SEQ ID NO: 31272 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
tctgttccattggtctatat

SEQ ID NO: 31273 - DNA, 20 bp, Artificial Sequence
  Description of Artificial Sequence: Synthetic oligonucleotide
  Target: ATXN1; (-) strand; PAM type: NNNNGHTT; PAM sequence: TCAGGTTT
ttccccatttcttgtttttg

SEQ ID NO: 31274 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tagggaatcctttccccatt

SEQ ID NO: 31275 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
cggctttctacatatggcta

SEQ ID NO: 31276 - DNA, 20 bp, Artificial Sequence
  Description of Artificial Sequence: Synthetic oligonucleotide
  Target: ATXN1; (-) strand; PAM type: NNNNGHTT; PAM sequence: TTCGGCTT
gtgtaaggaaggggttcagt

SEQ ID NO: 31277 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
tataaggtgtaaggaagggg

SEQ ID NO: 31278 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
aggttttcttctagggtttt

SEQ ID NO: 31279 - DNA, 20 bp, Artificial Sequence
  Description of Artificial Sequence: Synthetic oligonucleotide
  Target: ATXN1; (-) strand; PAM type: NNNNGHTT; PAM sequence: TAGGGTTT
gtattgcctaggttttcttc

SEQ ID NO: 31280 - DNA, 20 bp, Artificial Sequence
  Description of Artificial Sequence: Synthetic oligonucleotide
  Target: ATXN1; (-) strand; PAM type: NNNNGHTT; PAM sequence: CTAGGTTT
tatgtcctgaatggtattgc

SEQ ID NO: 31281 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
gcttttgttgccattgcttt

SEQ ID NO: 31282 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
acaattttggcttttgttgc

SEQ ID NO: 31283 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
attagatcccatttgacaat

SEQ ID NO: 31284 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
ctttggctgtgcagaagctc

SEQ ID NO: 31285 - DNA, 20 bp, Artificial Sequence
  Description of Artificial Sequence: Synthetic oligonucleotide
  Target: ATXN1; (-) strand; PAM type: NNNNGHTT; PAM sequence: GGTAGTTT
ggttgcctgttcactccgat

SEQ ID NO: 31286 - DNA, 20 bp, Artificial Sequence
  Description of Artificial Sequence: Synthetic oligonucleotide
  Target: ATXN1; (-) strand; PAM type: NNNNGHTT; PAM sequence: AGTAGATT
tattagccctttgtccgatg

SEQ ID NO: 31287 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
gtaaatttgtttgagttctt

SEQ ID NO: 31288 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tgtttgtttttttcttgtaa

SEQ ID NO: 31289 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
gcccactttttgatggggtt

SEQ ID NO: 31290 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
cttcgcccactttttgatgg

SEQ ID NO: 31291 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
gagatggtatgtcattgtgg

SEQ ID NO: 31292 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
ggtgtgagatggtatgtcat

SEQ ID NO: 31293 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
cctgttgtttcctgactttt

SEQ ID NO: 31294 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
tccacatcctctccagcacc

SEQ ID NO: 31295 - DNA, 20 bp, Artificial Sequence
  Description of Artificial Sequence: Synthetic oligonucleotide
  Target: ATXN1; (-) strand; PAM type: NNNNGHTT; PAM sequence: ACTAGTTT
ctgacttccacaatggttga

SEQ ID NO: 31296 - DNA, 20 bp, Artificial Sequence
  Description of Artificial Sequence: Synthetic oligonucleotide
  Target: ATXN1; (-) strand; PAM type: NNNNGHTT; PAM sequence: GCATGATT
gtgcatgtgtctttatagca

SEQ ID NO: 31297 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
tatgtgccacattttcttaa

SEQ ID NO: 31298 - DNA, 20 bp, Artificial Sequence
  Description of Artificial Sequence: Synthetic oligonucleotide
  Target: ATXN1; (-) strand; PAM type: NNNNGHTT; PAM sequence: TCCAGCTT
gtttgctgagaatgatggtt

SEQ ID NO: 31299 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
tgcgatagtttgctgagaat

SEQ ID NO: 31300 - DNA, 20 bp, Artificial Sequence
  Description of Artificial Sequence: Synthetic oligonucleotide
  Target: ATXN1; (-) strand; PAM type: NNNNGHTT; PAM sequence: GATAGTTT
gtttggttttttgtccttgc

SEQ ID NO: 31301 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
atgagtgagaacatgcggtg

SEQ ID NO: 31302 - DNA, 20 bp, Artificial Sequence
  Description of Artificial Sequence: Synthetic oligonucleotide
  Target: ATXN1; (-) strand; PAM type: NNNNGHTT; PAM sequence: CGGTGTTT
cacctatgagtgagaacatg

SEQ ID NO: 31303 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
agggtagatgtgcacaactt

SEQ ID NO: 31304 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
aatttttttaaaattatact

SEQ ID NO: 31305 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
agtctccaagtcttttgttt

SEQ ID NO: 31306 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
aagatgttagtctccaagtc

SEQ ID NO: 31307 - DNA, 20 bp, Artificial Sequence
  Description of Artificial Sequence: Synthetic oligonucleotide
  Target: ATXN1; (-) strand; PAM type: NNNNGHTT; PAM sequence: CACAGTTT
gatgtactatttattatagg

SEQ ID NO: 31308 - DNA, 20 bp, Artificial Sequence
  Description of Artificial Sequence: Synthetic oligonucleotide
  Target: ATXN1; (-) strand; PAM type: NNNNGHTT; PAM sequence: CCGGGATT
cgcctcggcctcccaaagtg

SEQ ID NO: 31309 - DNA, 20 bp, Artificial Sequence
  Description of Artificial Sequence: Synthetic oligonucleotide
  Target: ATXN1; (-) strand; PAM type: NNNNGHTT; PAM sequence: GCCAGATT
gacggggtttcactatgttg

SEQ ID NO: 31310 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttgtatttttagtagaga

SEQ ID NO: 31311 - DNA, 20 bp, Artificial Sequence
  Description of Artificial Sequence: Synthetic oligonucleotide
  Target: ATXN1; (-) strand; PAM type: NNNNGHTT; PAM sequence: GCTAGTTT
ggcgtgcgccatcacaccca

SEQ ID NO: 31312 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tggctcaggctcccgggtag

SEQ ID NO: 31313 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
tttaaccgttgttgttattg

SEQ ID NO: 31314 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
gctgctttaaccgttgttgt

SEQ ID NO: 31315 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
gagacactcaacataaaagc

SEQ ID NO: 31316 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
gcctgctctcttatacagat

SEQ ID NO: 31317 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
gtgttttgcctgctctctta

SEQ ID NO: 31318 - DNA, 20 bp, Artificial Sequence
  Description of Artificial Sequence: Synthetic oligonucleotide
  Target: ATXN1; (-) strand; PAM type: NNNNGHTT; PAM sequence: ACGTGTTT
cgtacagtgtgggctccatg

SEQ ID NO: 31319 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
ataggaaatgaaaataaatt

SEQ ID NO: 31320 - DNA, 20 bp, Artificial Sequence
  Description of Artificial Sequence: Synthetic oligonucleotide
  Target: ATXN1; (-) strand; PAM type: NNNNGHTT; PAM sequence: AACTGATT
agtagtgatttgtagcactt

SEQ ID NO: 31321 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
cgcctcgcaggagctgttag

SEQ ID NO: 31322 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
gcacttgagattttgatctg

SEQ ID NO: 31323 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
gtccctgggcaagtaagcac

SEQ ID NO: 31324 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
tactttcatcagcttagagc

SEQ ID NO: 31325 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
ttgaaaggacatttactttc

SEQ ID NO: 31326 - DNA, 20 bp, Artificial Sequence
  Description of Artificial Sequence: Synthetic oligonucleotide
  Target: ATXN1; (-) strand; PAM type: NNNNGHTT; PAM sequence: GTAAGATT
gtgggaagtacttcttgttg

SEQ ID NO: 31327 - DNA, 20 bp, Artificial Sequence
  Description of Artificial Sequence: Synthetic oligonucleotide
  Target: ATXN1; (-) strand; PAM type: NNNNGHTT; PAM sequence: TGCGGCTT
ggtgtagaatcacattgcac

SEQ ID NO: 31328 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
tccaaaggctccccgtaagg

SEQ ID NO: 31329 - DNA, 20 bp, Artificial Sequence
  Description of Artificial Sequence: Synthetic oligonucleotide
  Target: ATXN1; (-) strand; PAM type: NNNNGHTT; PAM sequence: CCTTGTTT
cacttgcattccagcagccc

SEQ ID NO: 31330 - DNA, 20 bp, Artificial Sequence
  Description of Artificial Sequence: Synthetic oligonucleotide
  Target: ATXN1; (-) strand; PAM type: NNNNGHTT; PAM sequence: AGACGTTT
aaagttctgcacattggtgc

SEQ ID NO: 31331 - DNA, 20 bp, Artificial Sequence
  Description of Artificial Sequence: Synthetic oligonucleotide
  Target: ATXN1; (-) strand; PAM type: NNNNGHTT; PAM sequence: GAGTGCTT
tgtgccccctccccctcgct

SEQ ID NO: 31332 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
tgtggtcgcttgattcactg

SEQ ID NO: 31333 - DNA, 20 bp, Artificial Sequence
  Description of Artificial Sequence: Synthetic oligonucleotide
  Target: ATXN1; (-) strand; PAM type: NNNNGHTT; PAM sequence: GCTTGATT
tgtagggctacagtgtggtc

SEQ ID NO: 31334 - DNA, 20 bp, Artificial Sequence
  Description of Artificial Sequence: Synthetic oligonucleotide
  Target: ATXN1; (-) strand; PAM type: NNNNGHTT; PAM sequence: GGTCGCTT
ctggtgtagggctacagtgt

SEQ ID NO: 31335 - DNA, 20 bp, Artificial Sequence
  Description of Artificial Sequence: Synthetic oligonucleotide
  Target: ATXN1; (-) strand; PAM type: NNNNGHTT; PAM sequence: TAGGGATT
ctctaggatgctccagcggg

SEQ ID NO: 31336 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
cataggctcactacctggat

SEQ ID NO: 31337 - DNA, 20 bp, Artificial Sequence
  Description of Artificial Sequence: Synthetic oligonucleotide
  Target: ATXN1; (-) strand; PAM type: NNNNGHTT; PAM sequence: CCTGGATT
gtcccagcataggctcacta

SEQ ID NO: 31338 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
ggtgagcaaaacagtagggc

SEQ ID NO: 31339 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gattttattctgctccatca

SEQ ID NO: 31340 - DNA, 20 bp, Artificial Sequence
  Description of Artificial Sequence: Synthetic oligonucleotide
  Target: ATXN1; (-) strand; PAM type: NNNNGHTT; PAM sequence: ACTTGATT
actatgtggatgtttacgtt

SEQ ID NO: 31341 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
gggaaagaattggactatgt

SEQ ID NO: 31342 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
tgggcaaatgacaccactca

SEQ ID NO: 31343 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
tgaatgagaggggggtagtg

SEQ ID NO: 31344 - DNA, 20 bp, Artificial Sequence
  Description of Artificial Sequence: Synthetic oligonucleotide
  Target: ATXN1; (-) strand; PAM type: NNNNGHTT; PAM sequence: CAAGGATT
attggagagatgttaataag

SEQ ID NO: 31345 - DNA, 20 bp, Artificial Sequence
  Description of Artificial Sequence: Synthetic oligonucleotide
  Target: ATXN1; (-) strand; PAM type: NNNNGHTT; PAM sequence: AGCAGATT
gtgacagaatggaaagaatg

SEQ ID NO: 31346 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
agacaggccccttgttctca

SEQ ID NO: 31347 - DNA, 20 bp, Artificial Sequence
  Description of Artificial Sequence: Synthetic oligonucleotide
  Target: ATXN1; (-) strand; PAM type: NNNNGHTT; PAM sequence: TGCGGCTT
ctaatcacaggtctgtgtgc

SEQ ID NO: 31348 - DNA, 20 bp, Artificial Sequence
  Description of Artificial Sequence: Synthetic oligonucleotide
  Target: ATXN1; (-) strand; PAM type: NNNNGHTT; PAM sequence: ACCTGCTT
aaattccagaaccacagagc

SEQ ID NO: 31349 - DNA, 20 bp, Artificial Sequence
  Description of Artificial Sequence: Synthetic oligonucleotide
  Target: ATXN1; (-) strand; PAM type: NNNNGHTT; PAM sequence: CAGTGATT
gaaaagtcaggtgtgtgttt

SEQ ID NO: 31350 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
agggatgtgaaaagtcaggt

SEQ ID NO: 31351 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
cttgtgagccaagcagagat

SEQ ID NO: 31352 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
gatgggctgaaggagcaata

SEQ ID NO: 31353 - DNA, 20 bp, Artificial Sequence
  Description of Artificial Sequence: Synthetic oligonucleotide
  Target: ATXN1; (-) strand; PAM type: NNNNGHTT; PAM sequence: ACAAGCTT
cagaatgaggagttgttcag

SEQ ID NO: 31354 - DNA, 20 bp, Artificial Sequence
  Description of Artificial Sequence: Synthetic oligonucleotide
  Target: ATXN1; (-) strand; PAM type: NNNNGHTT; PAM sequence: CCAAGCTT
tgcagagcacgtccttcagt

SEQ ID NO: 31355 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
ctgttaagcattatggtagg

SEQ ID NO: 31356 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
ctctagtactgggagcaggc

SEQ ID NO: 31357 - DNA, 20 bp, Artificial Sequence
  Description of Artificial Sequence: Synthetic oligonucleotide
  Target: ATXN1; (-) strand; PAM type: NNNNGHTT; PAM sequence: CAAAGATT
tccattcttcattaattcaa

SEQ ID NO: 31358 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcggcctcccaaagtg

SEQ ID NO: 31359 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtgtttttagtagaga

SEQ ID NO: 31360 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
accacgcacggaccattttt

SEQ ID NO: 31361 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
tgcctcagtctcctgagtag

SEQ ID NO: 31362 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
ggcctgaattcttgtcccag

SEQ ID NO: 31363 - DNA, 20 bp, Artificial Sequence
  Description of Artificial Sequence: Synthetic oligonucleotide
  Target: ATXN1; (-) strand; PAM type: NNNNGHTT; PAM sequence: GATGGATT
aatttgaaaagcatttatgg

SEQ ID NO: 31364 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
ctaggattgaaaagagatga

SEQ ID NO: 31365 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
agaaaattgtatatctaagt

SEQ ID NO: 31366 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
atgaatggggaggaggagcc

SEQ ID NO: 31367 - DNA, 20 bp, Artificial Sequence
  Description of Artificial Sequence: Synthetic oligonucleotide
  Target: ATXN1; (-) strand; PAM type: NNNNGHTT; PAM sequence: GCTAGCTT
agtaattaaaaaaaatagat

SEQ ID NO: 31368 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
ccatttgcatgacttcttac

SEQ ID NO: 31369 - DNA, 20 bp, Artificial Sequence
  Description of Artificial Sequence: Synthetic oligonucleotide
  Target: ATXN1; (-) strand; PAM type: NNNNGHTT; PAM sequence: ATCAGATT
gccaagtatgagtggcaaat

SEQ ID NO: 31370 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
aggatttggtgttgtatttg

SEQ ID NO: 31371 - DNA, 20 bp, Artificial Sequence
  Description of Artificial Sequence: Synthetic oligonucleotide
  Target: ATXN1; (-) strand; PAM type: NNNNGHTT; PAM sequence: GGAGGATT
gaggactggtggaacaaccg

SEQ ID NO: 31372 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
tagcctgtgcaacttcccca

SEQ ID NO: 31373 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
aacataaacttaggtataaa

SEQ ID NO: 31374 - DNA, 20 bp, Artificial Sequence
  Description of Artificial Sequence: Synthetic oligonucleotide
  Target: ATXN1; (-) strand; PAM type: NNNNGHTT; PAM sequence: ATCGGATT
tgctttcttcctttggatag

SEQ ID NO: 31375 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
ttactttttgttttgttttg

SEQ ID NO: 31376 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tggctttactttttgttttg

SEQ ID NO: 31377 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ctacttggctttactttttg

SEQ ID NO: 31378 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gttttctacttggctttact

SEQ ID NO: 31379 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
gcttcatttaatgttttcta

SEQ ID NO: 31380 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
ttaagatttttagcttcatt

SEQ ID NO: 31381 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
taatcatttttattaagatt

SEQ ID NO: 31382 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
ccttactgtaatcattttta

SEQ ID NO: 31383 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
gctctgtacttgtctctgtt

SEQ ID NO: 31384 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
attttcttttttaaaaatct

SEQ ID NO: 31385 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
atcctggtttttgtttttag

SEQ ID NO: 31386 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
gtgctatcctggtttttgtt

SEQ ID NO: 31387 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
attcagagtgctatcctggt

SEQ ID NO: 31388 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
tctgatattcagagtgctat

SEQ ID NO: 31389 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
atgtccctcaccatcattta

SEQ ID NO: 31390 - DNA, 20 bp, Artificial Sequence
  Description of Artificial Sequence: Synthetic oligonucleotide
  Target: ATXN1; (-) strand; PAM type: NNNNGHTT; PAM sequence: TGACGATT
tttgttagatgcatgtatgt

SEQ ID NO: 31391 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
tatttatttctcttcatagt

SEQ ID NO: 31392 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
ttcacagacgtggggaattt

SEQ ID NO: 31393 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
cgaggtcttgcaatgagccc

SEQ ID NO: 31394 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
gttcctaggtacacacactt

SEQ ID NO: 31395 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
ttgctttcctttctctatat

SEQ ID NO: 31396 - DNA, 20 bp, Artificial Sequence
  Description of Artificial Sequence: Synthetic oligonucleotide
  Target: ATXN1; (-) strand; PAM type: NNNNGHTT; PAM sequence: GCTTGCTT
ggcatgagacaccgtgcctg

SEQ ID NO: 31397 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
tataggcatgagacaccgtg

SEQ ID NO: 31398 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
tgccttggcctcccaaagtg

SEQ ID NO: 31399 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
ttttgtatttttagtagaga

SEQ ID NO: 31400 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaagtag

SEQ ID NO: 31401 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aaactctgttccctgggttc

SEQ ID NO: 31402 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
ttctttttttttttttgaga

SEQ ID NO: 31403 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
atttccttctttttccctac

SEQ ID NO: 31404 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
tcttcaaagaatgaactact

SEQ ID NO: 31405 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
aagctcttcaaagaatgaac

SEQ ID NO: 31406 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
ttcatttacttatttttgtg

SEQ ID NO: 31407 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
atgttttcatttacttattt

SEQ ID NO: 31408 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
atccccttttccatttttaa

SEQ ID NO: 31409 - DNA, 20 bp, Artificial Sequence
  Description of Artificial Sequence: Synthetic oligonucleotide
  Target: ATXN1; (-) strand; PAM type: NNNNGHTT; PAM sequence: GTAGGATT
ttcttatctatttagtgtct

SEQ ID NO: 31410 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
agttgtgagatttattgaca

SEQ ID NO: 31411 - DNA, 20 bp, Artificial Sequence
  Description of Artificial Sequence: Synthetic oligonucleotide
  Target: ATXN1; (-) strand; PAM type: NNNNGHTT; PAM sequence: GTGAGATT
ttttttatttcatccaagtt

SEQ ID NO: 31412 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
gttatgctttctatttttca

SEQ ID NO: 31413 - DNA, 20 bp, Artificial Sequence
  Description of Artificial Sequence: Synthetic oligonucleotide
  Target: ATXN1; (-) strand; PAM type: NNNNGHTT; PAM sequence: TTATGCTT
ttattcttgctattggtaag

SEQ ID NO: 31414 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
tatagccaactcttcagatt

SEQ ID NO: 31415 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
tcttaacatatagccaactc

SEQ ID NO: 31416 - DNA, 20 bp, Artificial Sequence
  Description of Artificial Sequence: Synthetic oligonucleotide
  Target: ATXN1; (-) strand; PAM type: NNNNGHTT; PAM sequence: CAAGGATT
cagttgtatcatcattgtgc

SEQ ID NO: 31417 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
gttctctttgtgtgaaggtt

SEQ ID NO: 31418 - DNA, 20 bp, Artificial Sequence
  Description of Artificial Sequence: Synthetic oligonucleotide
  Target: ATXN1; (-) strand; PAM type: NNNNGHTT; PAM sequence: TTGGGCTT
gaaattccacagtgaaatct

SEQ ID NO: 31419 - DNA, 20 bp, Artificial Sequence
  Description of Artificial Sequence: Synthetic oligonucleotide
  Target: ATXN1; (-) strand; PAM type: NNNNGHTT; PAM sequence: GTAAGATT
tattttctgaaagaatttat

SEQ ID NO: 31420 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
aaaatgtattcgtggagtcc

SEQ ID NO: 31421 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
tttagtgttagtgttagtaa

SEQ ID NO: 31422 - DNA, 20 bp, Artificial Sequence
  Description of Artificial Sequence: Synthetic oligonucleotide
  Target: ATXN1; (-) strand; PAM type: NNNNGHTT; PAM sequence: TAGGGTTT
tttctttatataatatttac

SEQ ID NO: 31423 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ttaagaacattggtctgtaa

SEQ ID NO: 31424 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
tttattaagtatttttgcga

SEQ ID NO: 31425 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
ttatgtggtgaattatattg

SEQ ID NO: 31426 - DNA, 20 bp, Artificial Sequence
  Description of Artificial Sequence: Synthetic oligonucleotide
  Target: ATXN1; (-) strand; PAM type: NNNNGHTT; PAM sequence: TATTGATT
ccgctttatgtggtgaatta

SEQ ID NO: 31427 - DNA, 20 bp, Artificial Sequence
  Description of Artificial Sequence: Synthetic oligonucleotide
  Target: ATXN1; (-) strand; PAM type: NNNNGHTT; PAM sequence: TTCCGCTT
tgttgagatgtcatatggtt

SEQ ID NO: 31428 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
ttgcctctgttgagatgtca

SEQ ID NO: 31429 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
ttttctaagaatttgtgttt

SEQ ID NO: 31430 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tcttttttctaagaatttgt

SEQ ID NO: 31431 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
attctcttttttctaagaat

SEQ ID NO: 31432 - DNA, 20 bp, Artificial Sequence
  Description of Artificial Sequence: Synthetic oligonucleotide
  Target: ATXN1; (-) strand; PAM type: NNNNGHTT; PAM sequence: CGAAGTTT
tttgccttttattggattga

SEQ ID NO: 31433 - DNA, 20 bp, Artificial Sequence
  Description of Artificial Sequence: Synthetic oligonucleotide
  Target: ATXN1; (-) strand; PAM type: NNNNGHTT; PAM sequence: ATTGGATT
aggtttttcatttgcctttt

SEQ ID NO: 31434 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
atttcatcatgatgttagct

SEQ ID NO: 31435 - DNA, 20 bp, Artificial Sequence
  Description of Artificial Sequence: Synthetic oligonucleotide
  Target: ATXN1; (-) strand; PAM type: NNNNGHTT; PAM sequence: TTATGCTT
tggtaaaatttaattgtact

SEQ ID NO: 31436 - DNA, 20 bp, Artificial Sequence
  Description of Artificial Sequence: Synthetic oligonucleotide
  Target: ATXN1; (-) strand; PAM type: NNNNGHTT; PAM sequence: CCCTGTTT
aatttctgccaggaatgttt

SEQ ID NO: 31437 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
ttttaatgaatttctgccag

SEQ ID NO: 31438 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
aaaagcctgttagaagttag

SEQ ID NO: 31439 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
tctctgtcttgttttttccc

SEQ ID NO: 31440 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
gatagcgtgagtcctctctg

SEQ ID NO: 31441 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
aatgttaaaattaaaaacta

SEQ ID NO: 31442 - DNA, 20 bp, Artificial Sequence
  Description of Artificial Sequence: Synthetic oligonucleotide
  Target: ATXN1; (-) strand; PAM type: NNNNGHTT; PAM sequence: GATCGCTT
tggtgaggctgaggtgggag

SEQ ID NO: 31443 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
cagaaagattgcttgagctc

SEQ ID NO: 31444 - DNA, 20 bp, Artificial Sequence
  Description of Artificial Sequence: Synthetic oligonucleotide
  Target: ATXN1; (-) strand; PAM type: NNNNGHTT; PAM sequence: GATTGCTT
ttgggaggccgaggcagaaa

SEQ ID NO: 31445 - DNA, 20 bp, Artificial Sequence
  Description of Artificial Sequence: Synthetic oligonucleotide
  Target: ATXN1; (-) strand; PAM type: NNNNGHTT; PAM sequence: GAAAGATT
tactttgggaggccgaggca

SEQ ID NO: 31446 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgggaggatcgcttgggccc

SEQ ID NO: 31447 - DNA, 20 bp, Artificial Sequence
  Description of Artificial Sequence: Synthetic oligonucleotide
  Target: ATXN1; (-) strand; PAM type: NNNNGHTT; PAM sequence: GATCGCTT
ttgggaggctgaggtgggag

SEQ ID NO: 31448 - DNA, 20 bp, Artificial Sequence
  Description of Artificial Sequence: Synthetic oligonucleotide
  Target: ATXN1; (-) strand; PAM type: NNNNGHTT; PAM sequence: TCTTGATT
cttaggtcaatactatattg

SEQ ID NO: 31449 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
caaaaatcatttggttttat

SEQ ID NO: 31450 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
cacacctttgtcaaaaatca

SEQ ID NO: 31451 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
gtatgaaacaacaattattg

SEQ ID NO: 31452 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
atgaggtgtaggggtcaaga

SEQ ID NO: 31453 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
taagatatgaggtgtagggg

SEQ ID NO: 31454 - DNA, 20 bp, Artificial Sequence
  Description of Artificial Sequence: Synthetic oligonucleotide
  Target: ATXN1; (-) strand; PAM type: NNNNGHTT; PAM sequence: TCTAGTTT
ctgttttctcctggaagatt

SEQ ID NO: 31455 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
ttatcctcctgttttctcct

SEQ ID NO: 31456 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
tggttgctaagatgttatcc

SEQ ID NO: 31457 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tttttgtgtctttataacat

SEQ ID NO: 31458 - DNA, 20 bp, Artificial Sequence
  Description of Artificial Sequence: Synthetic oligonucleotide
  Target: ATXN1; (-) strand; PAM type: NNNNGHTT; PAM sequence: ATATGCTT
aatttatcattttttaagat

SEQ ID NO: 31459 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
tacctttttcattttttaaa

SEQ ID NO: 31460 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
atatgaattttttctcagtg

SEQ ID NO: 31461 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
cagaaatatgaattttttct

SEQ ID NO: 31462 - DNA, 20 bp, Artificial Sequence
  Description of Artificial Sequence: Synthetic oligonucleotide
  Target: ATXN1; (-) strand; PAM type: NNNNGHTT; PAM sequence: TCTGGATT
tatatgagttctttatatag

SEQ ID NO: 31463 - DNA, 20 bp, Artificial Sequence
  Description of Artificial Sequence: Synthetic oligonucleotide
  Target: ATXN1; (-) strand; PAM type: NNNNGHTT; PAM sequence: GATGGTTT
tctatatctatatagatata

SEQ ID NO: 31464 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
gccagaggccaaggcaggca

SEQ ID NO: 31465 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
atcagtcagtactttttcgt

SEQ ID NO: 31466 - DNA, 20 bp, Artificial Sequence
  Description of Artificial Sequence: Synthetic oligonucleotide
  Target: ATXN1; (-) strand; PAM type: NNNNGHTT; PAM sequence: TTGAGCTT
taattgaattttgtttgttc

SEQ ID NO: 31467 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tttctgtcactgtaattgaa

SEQ ID NO: 31468 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
ctccccgtcatcaaccactg

SEQ ID NO: 31469 - DNA, 20 bp, Artificial Sequence
  Description of Artificial Sequence: Synthetic oligonucleotide
  Target: ATXN1; (-) strand; PAM type: NNNNGHTT; PAM sequence: CACTGCTT
tccacctccccgtcatcaac

SEQ ID NO: 31470 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
catcttaagcgtacagcgca

SEQ ID NO: 31471 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
atctttcttttcactaataa

SEQ ID NO: 31472 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
atctttcttttcactaataa

SEQ ID NO: 31473 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
acttgctgtctgccttgcgt

SEQ ID NO: 31474 - DNA, 20 bp, Artificial Sequence
  Description of Artificial Sequence: Synthetic oligonucleotide
  Target: ATXN1; (-) strand; PAM type: NNNNGHTT; PAM sequence: AGGCGTTT
caccgttcttcccctgcctt

SEQ ID NO: 31475 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
cgttcagttcactcgtgtct

SEQ ID NO: 31476 - DNA, 20 bp, Artificial Sequence
  Description of Artificial Sequence: Synthetic oligonucleotide
  Target: ATXN1; (-) strand; PAM type: NNNNGHTT; PAM sequence: ACTGGATT
tttttgagtgtaatgtggta

SEQ ID NO: 31477 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
gttccctcccctagcttcca

SEQ ID NO: 31478 - DNA, 20 bp, Artificial Sequence
  Description of Artificial Sequence: Synthetic oligonucleotide
  Target: ATXN1; (-) strand; PAM type: NNNNGHTT; PAM sequence: CCTAGCTT
gcctttactcagttccctcc

SEQ ID NO: 31479 - DNA, 20 bp, Artificial Sequence
  Description of Artificial Sequence: Synthetic oligonucleotide
  Target: ATXN1; (-) strand; PAM type: NNNNGHTT; PAM sequence: GGCTGATT
aaaggcactgttttgaaggt

SEQ ID NO: 31480 - DNA, 20 bp, Artificial Sequence
  Description of Artificial Sequence: Synthetic oligonucleotide
  Target: ATXN1; (-) strand; PAM type: NNNNGHTT; PAM sequence: CACTGTTT
ggacgttagccctagaaagg

SEQ ID NO: 31481 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
ggcgaatggcagttacttcc

SEQ ID NO: 31482 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
attcagttactaagggaatg

SEQ ID NO: 31483 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
atactccctcgtagccattt

SEQ ID NO: 31484 - DNA, 20 bp, Artificial Sequence
  Description of Artificial Sequence: Synthetic oligonucleotide
  Target: ATXN1; (-) strand; PAM type: NNNNGHTT; PAM sequence: TTGGGCTT
ctctggttcctgaggccagc

SEQ ID NO: 31485 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
tgttatctctggttcctgag

SEQ ID NO: 31486 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
tatgcttattatgagtcatc

SEQ ID NO: 31487 - DNA, 20 bp, Artificial Sequence
  Description of Artificial Sequence: Synthetic oligonucleotide
  Target: ATXN1; (-) strand; PAM type: NNNNGHTT; PAM sequence: CTATGCTT
ggcattaattgcttcatcaa

SEQ ID NO: 31488 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
agagaggaagagttggcatt

SEQ ID NO: 31489 - DNA, 20 bp, Artificial Sequence
  Description of Artificial Sequence: Synthetic oligonucleotide
  Target: ATXN1; (-) strand; PAM type: NNNNGHTT; PAM sequence: TAGCGATT
tcagccagggttaatactcc

SEQ ID NO: 31490 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
cttaccactccattgtttgg

SEQ ID NO: 31491 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
caactcttcccttaccactc

SEQ ID NO: 31492 - DNA, 20 bp, Artificial Sequence
  Description of Artificial Sequence: Synthetic oligonucleotide
  Target: ATXN1; (-) strand; PAM type: NNNNGHTT; PAM sequence: GATAGTTT
gagcggtccctctagattca

SEQ ID NO: 31493 - DNA, 20 bp, Artificial Sequence
  Description of Artificial Sequence: Synthetic oligonucleotide
  Target: ATXN1; (-) strand; PAM type: NNNNGHTT; PAM sequence: TCTAGATT
cttattcatggagcggtccc

SEQ ID NO: 31494 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
aattgaaatagaggaagcgg

SEQ ID NO: 31495 - DNA, 20 bp, Artificial Sequence
  Description of Artificial Sequence: Synthetic oligonucleotide
  Target: ATXN1; (-) strand; PAM type: NNNNGHTT; PAM sequence: CAGCGTTT
gaaagctattcctgtaaacc

SEQ ID NO: 31496 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
cccagaggccaatggcgtcc

SEQ ID NO: 31497 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
acacatcatttctacacagc

SEQ ID NO: 31498 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
aagaagtaactcttggattg

SEQ ID NO: 31499 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
agtagaaacaagaagtaact

SEQ ID NO: 31500 - DNA, 20 bp, Artificial Sequence
  Description of Artificial Sequence: Synthetic oligonucleotide
  Target: ATXN1; (-) strand; PAM type: NNNNGHTT; PAM sequence: CTCAGATT
atcactccactctatgtttt

SEQ ID NO: 31501 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
cacactgaaatcactccact

SEQ ID NO: 31502 - DNA, 20 bp, Artificial Sequence
  Description of Artificial Sequence: Synthetic oligonucleotide
  Target: ATXN1; (-) strand; PAM type: NNNNGHTT; PAM sequence: GTTGGATT
tggaggatgaaaagcatcca

SEQ ID NO: 31503 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
ctgggcgccaggcccagggg

SEQ ID NO: 31504 - DNA, 20 bp, Artificial Sequence
  Description of Artificial Sequence: Synthetic oligonucleotide
  Target: ATXN1; (-) strand; PAM type: NNNNGHTT; PAM sequence: CACAGATT
cctggaaggcttgtttagac

SEQ ID NO: 31505 - DNA, 20 bp, Artificial Sequence
  Description of Artificial Sequence: Synthetic oligonucleotide
  Target: ATXN1; (-) strand; PAM type: NNNNGHTT; PAM sequence: GCTTGTTT
gcatcagaggcacctggaag

SEQ ID NO: 31506 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
gtttgcatcagaggcacctg

SEQ ID NO: 31507 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
tttgacgattacattttatt

SEQ ID NO: 31508 - DNA, 20 bp, Artificial Sequence
  Description of Artificial Sequence: Synthetic oligonucleotide
  Target: ATXN1; (-) strand; PAM type: NNNNGHTT; PAM sequence: TGACGATT
gccagggaccagttaagatt

SEQ ID NO: 31509 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
tacgcgcggccagggaccag

SEQ ID NO: 31510 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cgctttggcctcccaaagta

SEQ ID NO: 31511 - DNA, 20 bp, Artificial Sequence
  Description of Artificial Sequence: Synthetic oligonucleotide
  Target: ATXN1; (-) strand; PAM type: NNNNGHTT; PAM sequence: ACCCGCTT
cttctggcctcatgtgatcc

SEQ ID NO: 31512 - DNA, 20 bp, Artificial Sequence
  Description of Artificial Sequence: Synthetic oligonucleotide
  Target: ATXN1; (-) strand; PAM type: NNNNGHTT; PAM sequence: ACGAGATT
atttttgtatttttataaag

SEQ ID NO: 31513 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctccgcctcctgggttc

SEQ ID NO: 31514 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
gtgtgtgtgtgtgtgtggtg

SEQ ID NO: 31515 - DNA, 20 bp, Artificial Sequence
  Description of Artificial Sequence: Synthetic oligonucleotide
  Target: ATXN1; (-) strand; PAM type: NNNNGHTT; PAM sequence: CCAGGTTT
agtagtacatgcaaatgggg

SEQ ID NO: 31516 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
cacaaaaaggaatagattgg

SEQ ID NO: 31517 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
ggaaaacaatcacaaaaagg

SEQ ID NO: 31518 - DNA, 20 bp, Artificial Sequence
  Description of Artificial Sequence: Synthetic oligonucleotide
  Target: ATXN1; (-) strand; PAM type: NNNNGHTT; PAM sequence: GGAGGTTT
caaatgttaagtgtcagctg

SEQ ID NO: 31519 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
actgttaaatatttatatat

SEQ ID NO: 31520 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
agttcagcctacacccatca

SEQ ID NO: 31521 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
gacttgatggcatagaatgg

SEQ ID NO: 31522 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
acaaattagagtgtagggaa

SEQ ID NO: 31523 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
gagaaatgaaagaagccaca

SEQ ID NO: 31524 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
tgtggcatatgcagatgtat

SEQ ID NO: 31525 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
tgtttaaatagaagctattg

SEQ ID NO: 31526 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
gccaggctgatgggatatac

SEQ ID NO: 31527 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
aaaataatagcctctgtctc

SEQ ID NO: 31528 - DNA, 20 bp, Artificial Sequence
  Description of Artificial Sequence: Synthetic oligonucleotide
  Target: ATXN1; (-) strand; PAM type: NNNNGHTT; PAM sequence: ACTAGCTT
agtcagctgccctaaatttt

SEQ ID NO: 31529 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
gtgcctgaagtctgcaacat

SEQ ID NO: 31530 - DNA, 20 bp, Artificial Sequence
  Description of Artificial Sequence: Synthetic oligonucleotide
  Target: ATXN1; (-) strand; PAM type: NNNNGHTT; PAM sequence: AGGAGCTT
tcagaatcactaacagaaat

SEQ ID NO: 31531 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
taccaacacaaagcatggtc

SEQ ID NO: 31532 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
attctaggggttttctaatc

SEQ ID NO: 31533 - DNA, 20 bp, Artificial Sequence
  Description of Artificial Sequence: Synthetic oligonucleotide
  Target: ATXN1; (-) strand; PAM type: NNNNGHTT; PAM sequence: AGGGGTTT
tggactttggcttatattct

SEQ ID NO: 31534 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
aaatgctaaggagtatggac

SEQ ID NO: 31535 - DNA, 20 bp, Artificial Sequence
  Description of Artificial Sequence: Synthetic oligonucleotide
  Target: ATXN1; (-) strand; PAM type: NNNNGHTT; PAM sequence: TAGGGCTT
ttgtctaacacaactagagg

SEQ ID NO: 31536 - DNA, 20 bp, Artificial Sequence
  Description of Artificial Sequence: Synthetic oligonucleotide
  Target: ATXN1; (-) strand; PAM type: NNNNGHTT; PAM sequence: GAATGCTT
catggtatccagtaatttgg

SEQ ID NO: 31537 - DNA, 20 bp, Artificial Sequence
  Description of Artificial Sequence: Synthetic oligonucleotide
  Target: ATXN1; (-) strand; PAM type: NNNNGHTT; PAM sequence: CTAGGCTT
gcagaaatggctgtggtcct

SEQ ID NO: 31538 - DNA, 20 bp, Artificial Sequence
  Description of Artificial Sequence: Synthetic oligonucleotide
  Target: ATXN1; (-) strand; PAM type: NNNNGHTT; PAM sequence: AGGAGATT
atgtttgagctctgtctcaa

SEQ ID NO: 31539 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
gaatggctccatagggttgg

SEQ ID NO: 31540 - DNA, 20 bp, Artificial Sequence
  Description of Artificial Sequence: Synthetic oligonucleotide
  Target: ATXN1; (-) strand; PAM type: NNNNGHTT; PAM sequence: GGAAGTTT
aagcacaatccctgcccttg

SEQ ID NO: 31541 - DNA, 20 bp, Artificial Sequence
  Description of Artificial Sequence: Synthetic oligonucleotide
  Target: ATXN1; (-) strand; PAM type: NNNNGHTT; PAM sequence: GCCAGCTT
ttccccaggcaaaatcacta

SEQ ID NO: 31542 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
accattacaacatactgaaa

SEQ ID NO: 31543 - DNA, 20 bp, Artificial Sequence
  Description of Artificial Sequence: Synthetic oligonucleotide
  Target: ATXN1; (-) strand; PAM type: NNNNGHTT; PAM sequence: AGATGATT
ttgtgagttttctggtttac

SEQ ID NO: 31544 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
ttggaggacgttgtgagttt

SEQ ID NO: 31545 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
ttctacttttggaggacgtt

SEQ ID NO: 31546 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
actatctgatcctcatcaga

SEQ ID NO: 31547 - DNA, 20 bp, Artificial Sequence
  Description of Artificial Sequence: Synthetic oligonucleotide
  Target: ATXN1; (-) strand; PAM type: NNNNGHTT; PAM sequence: ATTTGATT
ttttgcactacactggcaga

SEQ ID NO: 31548 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
ataatttgtctaatgtctat

SEQ ID NO: 31549 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
atccagcctgttcttgtaaa

SEQ ID NO: 31550 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
taagtccctttggaatggat

SEQ ID NO: 31551 - DNA, 20 bp, Artificial Sequence
  Description of Artificial Sequence: Synthetic oligonucleotide
  Target: ATXN1; (-) strand; PAM type: NNNNGHTT; PAM sequence: GTTGGCTT
gtagtaattatctttcttca

SEQ ID NO: 31552 - DNA, 20 bp, Artificial Sequence
  Description of Artificial Sequence: Synthetic oligonucleotide
  Target: ATXN1; (-) strand; PAM type: NNNNGHTT; PAM sequence: GGTGGCTT
tctgttcatctcaggagaag

SEQ ID NO: 31553 - DNA, 20 bp, Artificial Sequence
  Description of Artificial Sequence: Synthetic oligonucleotide
  Target: ATXN1; (-) strand; PAM type: NNNNGHTT; PAM sequence: GTTTGCTT
agatccatatggagtcaggt

SEQ ID NO: 31554 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
aggaagatccatatggagtc

SEQ ID NO: 31555 - DNA, 20 bp, Artificial Sequence
  Description of Artificial Sequence: Synthetic oligonucleotide
  Target: ATXN1; (-) strand; PAM type: NNNNGHTT; PAM sequence: TGCTGATT
tctgtgtccagggcttgcca

SEQ ID NO: 31556 - DNA, 20 bp, Artificial Sequence
  Description of Artificial Sequence: Synthetic oligonucleotide
  Target: ATXN1; (-) strand; PAM type: NNNNGHTT; PAM sequence: CAGGGCTT
gatggcttctggtctgtgtc

SEQ ID NO: 31557 - DNA, 20 bp, Artificial Sequence
  Description of Artificial Sequence: Synthetic oligonucleotide
  Target: ATXN1; (-) strand; PAM type: NNNNGHTT; PAM sequence: GATGGCTT
ccctgcttttggagactaga

SEQ ID NO: 31558 - DNA, 20 bp, Artificial Sequence
  Description of Artificial Sequence: Synthetic oligonucleotide
  Target: ATXN1; (-) strand; PAM type: NNNNGHTT; PAM sequence: CCCTGCTT
atacgatcgccgccttctgc

SEQ ID NO: 31559 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
tgtcctgaagcaccaggttc

SEQ ID NO: 31560 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
atcacttaattaaatcttgt

SEQ ID NO: 31561 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
gttgctcttatttactttcc

SEQ ID NO: 31562 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
tcattgacccttcactatga

SEQ ID NO: 31563 - DNA, 20 bp, Artificial Sequence
  Description of Artificial Sequence: Synthetic oligonucleotide
  Target: ATXN1; (-) strand; PAM type: NNNNGHTT; PAM sequence: CTATGATT
tgggcatcattgacccttca

SEQ ID NO: 31564 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
ctatacactgagcctttgtt

SEQ ID NO: 31565 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
ctaacttctatacactgagc

SEQ ID NO: 31566 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
actgtcatatttttgtggct

SEQ ID NO: 31567 - DNA, 20 bp, Artificial Sequence
  Description of Artificial Sequence: Synthetic oligonucleotide
  Target: ATXN1; (-) strand; PAM type: NNNNGHTT; PAM sequence: GCAAGATT
atttggccttgcatatcctg

SEQ ID NO: 31568 - DNA, 20 bp, Artificial Sequence
  Description of Artificial Sequence: Synthetic oligonucleotide
  Target: ATXN1; (-) strand; PAM type: NNNNGHTT; PAM sequence: CTTGGTTT
agttagttttgttttccttc

SEQ ID NO: 31569 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tcttgctccgttgcagttag

SEQ ID NO: 31570 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
tgcattcttgctccgttgca

SEQ ID NO: 31571 - DNA, 20 bp, Artificial Sequence
  Description of Artificial Sequence: Synthetic oligonucleotide
  Target: ATXN1; (-) strand; PAM type: NNNNGHTT; PAM sequence: AGGTGCTT
gtcacagttaacaggaaagg

SEQ ID NO: 31572 - DNA, 20 bp, Artificial Sequence
  Description of Artificial Sequence: Synthetic oligonucleotide
  Target: ATXN1; (-) strand; PAM type: NNNNGHTT; PAM sequence: AGCAGCTT
aagcattttctttggaaacc

SEQ ID NO: 31573 - DNA, 20 bp, Artificial Sequence
  Description of Artificial Sequence: Synthetic oligonucleotide
  Target: ATXN1; (-) strand; PAM type: NNNNGHTT; PAM sequence: AAACGCTT
tcaacacagcatttccagcg

SEQ ID NO: 31574 - DNA, 20 bp, Artificial Sequence
  Description of Artificial Sequence: Synthetic oligonucleotide
  Target: ATXN1; (-) strand; PAM type: NNNNGHTT; PAM sequence: GTTGGTTT
agatggtctccactgtagct

SEQ ID NO: 31575 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
acacatctgtgcgtacaatg

SEQ ID NO: 31576 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
ggtagaaaaacttaggaaat

SEQ ID NO: 31577 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
gtggagatgaatcattcaac

SEQ ID NO: 31578 - DNA, 20 bp, Artificial Sequence
  Description of Artificial Sequence: Synthetic oligonucleotide
  Target: ATXN1; (-) strand; PAM type: NNNNGHTT; PAM sequence: GCCAGATT
atcataaattcacgtgaaag

SEQ ID NO: 31579 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tttaaaatttgttgtgctta

SEQ ID NO: 31580 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
ctaaagagctttaaaatttg

SEQ ID NO: 31581 - DNA, 20 bp, Artificial Sequence
  Description of Artificial Sequence: Synthetic oligonucleotide
  Target: ATXN1; (-) strand; PAM type: NNNNGHTT; PAM sequence: AAGAGCTT
tataagaagacagaggacta

SEQ ID NO: 31582 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
tttttgatgtagaaatactg

SEQ ID NO: 31583 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
gggggaatgtataaaaaaat

SEQ ID NO: 31584 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
aataaagttgctctttcttc

SEQ ID NO: 31585 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
gcatgctgcttgcgacattt

SEQ ID NO: 31586 - DNA, 20 bp, Artificial Sequence
  Description of Artificial Sequence: Synthetic oligonucleotide
  Target: ATXN1; (-) strand; PAM type: NNNNGHTT; PAM sequence: TGCTGCTT
cttgacagtttttgacagca

SEQ ID NO: 31587 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
aatcaataattatttcactt

SEQ ID NO: 31588 - DNA, 20 bp, Artificial Sequence
  Description of Artificial Sequence: Synthetic oligonucleotide
  Target: ATXN1; (-) strand; PAM type: NNNNGHTT; PAM sequence: ATTCGTTT
atcttcatttattaatctac

SEQ ID NO: 31589 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
ggtttttctagttgtagatg

SEQ ID NO: 31590 - DNA, 20 bp, Artificial Sequence
  Description of Artificial Sequence: Synthetic oligonucleotide
  Target: ATXN1; (-) strand; PAM type: NNNNGHTT; PAM sequence: TCGGGTTT
cctgactggcagattcgctg

SEQ ID NO: 31591 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
taagccctatagccctgact

SEQ ID NO: 31592 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
gttaatttttatcttcttat

SEQ ID NO: 31593 - DNA, 20 bp, Artificial Sequence
  Description of Artificial Sequence: Synthetic oligonucleotide
  Target: ATXN1; (-) strand; PAM type: NNNNGHTT; PAM sequence: ATTGGATT
ctcttagaagaacagtggtc

SEQ ID NO: 31594 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
agcgtcactccagtctctgc

SEQ ID NO: 31595 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
tctggtggttccaggcgttc

SEQ ID NO: 31596 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
taaatgtgatgggaaactct

SEQ ID NO: 31597 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
tgatctagaggctgcaggag

SEQ ID NO: 31598 - DNA, 20 bp, Artificial Sequence
  Description of Artificial Sequence: Synthetic oligonucleotide
  Target: ATXN1; (-) strand; PAM type: NNNNGHTT; PAM sequence: AGGAGCTT
tgaattgatctagaggctgc

SEQ ID NO: 31599 - DNA, 20 bp, Artificial Sequence
  Description of Artificial Sequence: Synthetic oligonucleotide
  Target: ATXN1; (-) strand; PAM type: NNNNGHTT; PAM sequence: ATGGGCTT
gtcagggaaagtcttagggg

SEQ ID NO: 31600 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ggcaggggcgaaggggattc

SEQ ID NO: 31601 - DNA, 20 bp, Artificial Sequence
  Description of Artificial Sequence: Synthetic oligonucleotide
  Target: ATXN1; (-) strand; PAM type: NNNNGHTT; PAM sequence: AGGGGATT
aagagtgatggcaggggcga

SEQ ID NO: 31602 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
tgtctaagtccctgccctca

SEQ ID NO: 31603 - DNA, 20 bp, Artificial Sequence
  Description of Artificial Sequence: Synthetic oligonucleotide
  Target: ATXN1; (-) strand; PAM type: NNNNGHTT; PAM sequence: TCAGGCTT
tcttgatggtgctaatcaag

SEQ ID NO: 31604 - DNA, 20 bp, Artificial Sequence
  Description of Artificial Sequence: Synthetic oligonucleotide
  Target: ATXN1; (-) strand; PAM type: NNNNGHTT; PAM sequence: CTGAGTTT
aaaagccatgtttggatcaa

SEQ ID NO: 31605 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
aaataataaaagcaaaaaag

SEQ ID NO: 31606 - DNA, 20 bp, Artificial Sequence
  Description of Artificial Sequence: Synthetic oligonucleotide
  Target: ATXN1; (-) strand; PAM type: NNNNGHTT; PAM sequence: CCATGCTT
atttaggcctctcctttata

SEQ ID NO: 31607 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
ggctcacatagctggtagga

SEQ ID NO: 31608 - DNA, 20 bp, Artificial Sequence
  Description of Artificial Sequence: Synthetic oligonucleotide
  Target: ATXN1; (-) strand; PAM type: NNNNGHTT; PAM sequence: GCATGTTT
gccctgtggatatagacaca

SEQ ID NO: 31609 - DNA, 20 bp, Artificial Sequence
  Description of Artificial Sequence: Synthetic oligonucleotide
  Target: ATXN1; (-) strand; PAM type: NNNNGHTT; PAM sequence: GTATGCTT
tttgcaaaatgtgcctagag

SEQ ID NO: 31610 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
attacatctgcacaagtctt

SEQ ID NO: 31611 - DNA, 20 bp, Artificial Sequence
  Description of Artificial Sequence: Synthetic oligonucleotide
  Target: ATXN1; (-) strand; PAM type: NNNNGHTT; PAM sequence: CTCAGATT
tgggtgtgtcaagcacaaat

SEQ ID NO: 31612 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
ctgtcttaagggaaccatct

SEQ ID NO: 31613 - DNA, 20 bp, Artificial Sequence
  Description of Artificial Sequence: Synthetic oligonucleotide
  Target: ATXN1; (-) strand; PAM type: NNNNGHTT; PAM sequence: TCCTGATT
gtaaccttgttcgtagtagc

SEQ ID NO: 31614 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
aatgaaaaggaataatgttt

SEQ ID NO: 31615 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
tttgaaataatgaaaaggaa

SEQ ID NO: 31616 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tggtacatatttcaaatgtg

SEQ ID NO: 31617 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
cacttggtacatatttcaaa

SEQ ID NO: 31618 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cacctcagcctcccaaagtg

SEQ ID NO: 31619 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
tcttctgaggaaaacaaatg

SEQ ID NO: 31620 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
tcaatcagatcctccaagaa

SEQ ID NO: 31621 - DNA, 20 bp, Artificial Sequence
  Description of Artificial Sequence: Synthetic oligonucleotide
  Target: ATXN1; (-) strand; PAM type: NNNNGHTT; PAM sequence: TGTAGCTT
gggtttttctgggagaggat

SEQ ID NO: 31622 - DNA, 20 bp, Artificial Sequence
  Description of Artificial Sequence: Synthetic oligonucleotide
  Target: ATXN1; (-) strand; PAM type: NNNNGHTT; PAM sequence: AGAGGATT
tgtatgtgggtttttctggg

SEQ ID NO: 31623 - DNA, 20 bp, Artificial Sequence
  Description of Artificial Sequence: Synthetic oligonucleotide
  Target: ATXN1; (-) strand; PAM type: NNNNGHTT; PAM sequence: GTGGGTTT
cagcatgacattctgtgtat

SEQ ID NO: 31624 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
ctgcatagtttgcaacatga

SEQ ID NO: 31625 - DNA, 20 bp, Artificial Sequence
  Description of Artificial Sequence: Synthetic oligonucleotide
  Target: ATXN1; (-) strand; PAM type: NNNNGHTT; PAM sequence: CATAGTTT
ctcaacatcagttaatgctg

SEQ ID NO: 31626 - DNA, 20 bp, Artificial Sequence
  Description of Artificial Sequence: Synthetic oligonucleotide
  Target: ATXN1; (-) strand; PAM type: NNNNGHTT; PAM sequence: GCGTGCTT
ttgggagaagtgtgtaatgt

SEQ ID NO: 31627 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
aatgaatgcatctcctgttg

SEQ ID NO: 31628 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
atttcagtaaaattaaaagc

SEQ ID NO: 31629 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
tattattagtgagcacttcc

SEQ ID NO: 31630 - DNA, 20 bp, Artificial Sequence
  Description of Artificial Sequence: Synthetic oligonucleotide
  Target: ATXN1; (-) strand; PAM type: NNNNGHTT; PAM sequence: ATCAGTTT
gagatggttcagtgtatgga

SEQ ID NO: 31631 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
ttttattatcgttatttact

SEQ ID NO: 31632 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
ttgtagatgtttcctgttat

SEQ ID NO: 31633 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
tattttctctggataattgt

SEQ ID NO: 31634 - DNA, 20 bp, Artificial Sequence
  Description of Artificial Sequence: Synthetic oligonucleotide
  Target: ATXN1; (-) strand; PAM type: NNNNGHTT; PAM sequence: GTTTGATT
taaagccaatagagactcag

SEQ ID NO: 31635 - DNA, 20 bp, Artificial Sequence
  Description of Artificial Sequence: Synthetic oligonucleotide
  Target: ATXN1; (-) strand; PAM type: NNNNGHTT; PAM sequence: TCAGGTTT
tttgtaaagccaatagagac

SEQ ID NO: 31636 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
tttattacaggaaatattaa

SEQ ID NO: 31637 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
aagaacctgagtaactacac

SEQ ID NO: 31638 - DNA, 20 bp, Artificial Sequence
  Description of Artificial Sequence: Synthetic oligonucleotide
  Target: ATXN1; (-) strand; PAM type: NNNNGHTT; PAM sequence: TTCAGCTT
tggggaaagcaacagtgtgt

SEQ ID NO: 31639 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
cagccatggggaaagcaaca

SEQ ID NO: 31640 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
gtgtgtgagagagagtgtgt

SEQ ID NO: 31641 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
tatttctgagaagtctgtat

SEQ ID NO: 31642 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
agtttacaatgtttagttga

SEQ ID NO: 31643 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
agtaaatagtccaaagttta

SEQ ID NO: 31644 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
ccactgaaaagtaaatagtc

SEQ ID NO: 31645 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
tcaactgcagaaggatagat

SEQ ID NO: 31646 - DNA, 20 bp, Artificial Sequence
  Description of Artificial Sequence: Synthetic oligonucleotide
  Target: ATXN1; (-) strand; PAM type: NNNNGHTT; PAM sequence: GATAGATT
actcatttcaactgcagaag

SEQ ID NO: 31647 - DNA, 20 bp, Artificial Sequence
  Description of Artificial Sequence: Synthetic oligonucleotide
  Target: ATXN1; (-) strand; PAM type: NNNNGHTT; PAM sequence: AGTTGATT
gattgtagcttagtttttat

SEQ ID NO: 31648 - DNA, 20 bp, Artificial Sequence
  Description of Artificial Sequence: Synthetic oligonucleotide
  Target: ATXN1; (-) strand; PAM type: NNNNGHTT; PAM sequence: CTTAGTTT
ggattaagtaatgattgtag

SEQ ID NO: 31649 - DNA, 20 bp, Artificial Sequence
  Description of Artificial Sequence: Synthetic oligonucleotide
  Target: ATXN1; (-) strand; PAM type: NNNNGHTT; PAM sequence: TGTAGCTT
ttttaggattaagtaatgat

SEQ ID NO: 31650 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
ctcctccttttaggattaag

SEQ ID NO: 31651 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
tttgtctcttcctcctcctt

SEQ ID NO: 31652 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
ttatctataaaagattgtac

SEQ ID NO: 31653 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
tagaacatgattttatctat

SEQ ID NO: 31654 - DNA, 20 bp, Artificial Sequence
  Description of Artificial Sequence: Synthetic oligonucleotide
  Target: ATXN1; (-) strand; PAM type: NNNNGHTT; PAM sequence: ACATGATT
atccaaaggggtgatataga

SEQ ID NO: 31655 - DNA, 20 bp, Artificial Sequence
  Description of Artificial Sequence: Synthetic oligonucleotide
  Target: ATXN1; (-) strand; PAM type: NNNNGHTT; PAM sequence: AAAGGTTT
atgcgctagattcataaata

SEQ ID NO: 31656 - DNA, 20 bp, Artificial Sequence
  Description of Artificial Sequence: Synthetic oligonucleotide
  Target: ATXN1; (-) strand; PAM type: NNNNGHTT; PAM sequence: GCTAGATT
tagcctacgaggggaaatgc

SEQ ID NO: 31657 - DNA, 20 bp, Artificial Sequence
  Description of Artificial Sequence: Synthetic oligonucleotide
  Target: ATXN1; (-) strand; PAM type: NNNNGHTT; PAM sequence: AAAAGCTT
aatgcagggaatttgtccag

SEQ ID NO: 31658 - DNA, 20 bp, Artificial Sequence
  Description of Artificial Sequence: Synthetic oligonucleotide
  Target: ATXN1; (-) strand; PAM type: NNNNGHTT; PAM sequence: GTCAGATT
gggttcagaaatttcaaaat

SEQ ID NO: 31659 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
ggctcatgggctattttttt

SEQ ID NO: 31660 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
ctgtgataaacatttagtga

SEQ ID NO: 31661 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
tatgatttgtgtaagaatca

SEQ ID NO: 31662 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
aactttcctcatagtctctt

SEQ ID NO: 31663 - DNA, 20 bp, Artificial Sequence
  Description of Artificial Sequence: Synthetic oligonucleotide
  Target: ATXN1; (-) strand; PAM type: NNNNGHTT; PAM sequence: TCATGCTT
atcttttgaacgtgaagtca

SEQ ID NO: 31664 - DNA, 20 bp, Artificial Sequence
  Description of Artificial Sequence: Synthetic oligonucleotide
  Target: ATXN1; (-) strand; PAM type: NNNNGHTT; PAM sequence: CAGAGATT
gcatgtgagtcacacacagg

SEQ ID NO: 31665 - DNA, 20 bp, Artificial Sequence
  Description of Artificial Sequence: Synthetic oligonucleotide
  Target: ATXN1; (-) strand; PAM type: NNNNGHTT; PAM sequence: AGCTGATT
cctcaccaatcagttgggag

SEQ ID NO: 31666 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
taaagggaatgccagtcact

SEQ ID NO: 31667 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
ttgcctgtttcagtttctca

SEQ ID NO: 31668 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
tatttttcctctttgcctgt

SEQ ID NO: 31669 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
cagtaatatttttcctcttt

SEQ ID NO: 31670 - DNA, 20 bp, Artificial Sequence
  Description of Artificial Sequence: Synthetic oligonucleotide
  Target: ATXN1; (-) strand; PAM type: NNNNGHTT; PAM sequence: TCTCGATT
tggagacttcatgaattttc

SEQ ID NO: 31671 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
tccagctcttccatgaccat

SEQ ID NO: 31672 - DNA, 20 bp, Artificial Sequence
  Description of Artificial Sequence: Synthetic oligonucleotide
  Target: ATXN1; (-) strand; PAM type: NNNNGHTT; PAM sequence: GTTTGATT
ctctcaggggtgaacactgg

SEQ ID NO: 31673 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
tcgtctctcaggggtgaaca

SEQ ID NO: 31674 - DNA, 20 bp, Artificial Sequence
  Description of Artificial Sequence: Synthetic oligonucleotide
  Target: ATXN1; (-) strand; PAM type: NNNNGHTT; PAM sequence: GGTTGCTT
tgtttttcaccctgttcatg

SEQ ID NO: 31675 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
tgtaaatagccagctccagt

SEQ ID NO: 31676 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
gtctgaatggttgtcccgta

SEQ ID NO: 31677 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
gcaatcaaacctgactctat

SEQ ID NO: 31678 - DNA, 20 bp, Artificial Sequence
  Description of Artificial Sequence: Synthetic oligonucleotide
  Target: ATXN1; (-) strand; PAM type: NNNNGHTT; PAM sequence: ACCTGATT
tgagtcatgacagtaatcaa

SEQ ID NO: 31679 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
aggtttgacattaaaataag

SEQ ID NO: 31680 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
atggatcataatttagttta

SEQ ID NO: 31681 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
ttctctcaaatggatcataa

SEQ ID NO: 31682 - DNA, 20 bp, Artificial Sequence
  Description of Artificial Sequence: Synthetic oligonucleotide
  Target: ATXN1; (-) strand; PAM type: NNNNGHTT; PAM sequence: GTTAGTTT
tcttcaaaacttaataaacg

SEQ ID NO: 31683 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
tgtagttcatgcttttctct

SEQ ID NO: 31684 - DNA, 20 bp, Artificial Sequence
  Description of Artificial Sequence: Synthetic oligonucleotide
  Target: ATXN1; (-) strand; PAM type: NNNNGHTT; PAM sequence: TCATGCTT
cctttattgctgtgtgtagt

SEQ ID NO: 31685 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
ttaccctgaattgaatggga

SEQ ID NO: 31686 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tggatttagctctttttctt

SEQ ID NO: 31687 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
aaactggatttagctctttt

SEQ ID NO: 31688 - DNA, 20 bp, Artificial Sequence
  Description of Artificial Sequence: Synthetic oligonucleotide
  Target: ATXN1; (-) strand; PAM type: NNNNGHTT; PAM sequence: ACTGGATT
attcggtttctgattcaaaa

SEQ ID NO: 31689 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
gatgtttttctaaattcggt

SEQ ID NO: 31690 - DNA, 20 bp, Artificial Sequence
  Description of Artificial Sequence: Synthetic oligonucleotide
  Target: ATXN1; (-) strand; PAM type: NNNNGHTT; PAM sequence: TTCGGTTT
aaccaagatgtttttctaaa

SEQ ID NO: 31691 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
ttcacagggcatttcaacca

SEQ ID NO: 31692 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
caaatatgcacaatgagtgc

SEQ ID NO: 31693 - DNA, 20 bp, Artificial Sequence
  Description of Artificial Sequence: Synthetic oligonucleotide
  Target: ATXN1; (-) strand; PAM type: NNNNGHTT; PAM sequence: GGATGATT
aacatagtcagcttgtgaaa

SEQ ID NO: 31694 - DNA, 20 bp, Artificial Sequence
  Description of Artificial Sequence: Synthetic oligonucleotide
  Target: ATXN1; (-) strand; PAM type: NNNNGHTT; PAM sequence: GTCAGCTT
aaaatgttggaataaacata

SEQ ID NO: 31695 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
ggagcgcttaagctttcttt

SEQ ID NO: 31696 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
gtcttttcccttaggagcgc

SEQ ID NO: 31697 - DNA, 20 bp, Artificial Sequence
  Description of Artificial Sequence: Synthetic oligonucleotide
  Target: ATXN1; (-) strand; PAM type: NNNNGHTT; PAM sequence: GAGCGCTT
tattgagtcttttcccttag

SEQ ID NO: 31698 - DNA, 20 bp, Artificial Sequence
  Description of Artificial Sequence: Synthetic oligonucleotide
  Target: ATXN1; (-) strand; PAM type: NNNNGHTT; PAM sequence: AATTGATT
tccttgtgtacttggatctg

SEQ ID NO: 31699 - DNA, 20 bp, Artificial Sequence
  Description of Artificial Sequence: Synthetic oligonucleotide
  Target: ATXN1; (-) strand; PAM type: NNNNGHTT; PAM sequence: TGGTGATT
tctagggcttcatcttaata

SEQ ID NO: 31700 - DNA, 20 bp, Artificial Sequence
  Description of Artificial Sequence: Synthetic oligonucleotide
  Target: ATXN1; (-) strand; PAM type: NNNNGHTT; PAM sequence: TAGGGCTT
gggtataagaagctactttc

SEQ ID NO: 31701 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgccttggcctcccaaagtg

SEQ ID NO: 31702 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
tttttgtattttagtagaga

SEQ ID NO: 31703 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagccacctgtgtag

SEQ ID NO: 31704 - DNA, 20 bp, Artificial Sequence
  Description of Artificial Sequence: Synthetic oligonucleotide
  Target: ATXN1; (-) strand; PAM type: NNNNGHTT; PAM sequence: CAGCGATT
gcctctgctcccccgggttc

SEQ ID NO: 31705 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
gagaagttctaccttagtgt

SEQ ID NO: 31706 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
tacgaagagaagttctacct

SEQ ID NO: 31707 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
ttttgtctttttagtagaga

SEQ ID NO: 31708 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
agctgggattacaggcaccc

SEQ ID NO: 31709 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cagcctcctgagtagagtag

SEQ ID NO: 31710 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aacctccacctcccggcttc

SEQ ID NO: 31711 - DNA, 20 bp, Artificial Sequence
  Description of Artificial Sequence: Synthetic oligonucleotide
  Target: ATXN1; (-) strand; PAM type: NNNNGHTT; PAM sequence: CCCGGCTT
gctcactgcaacctccacct

SEQ ID NO: 31712 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
ttctttgtttttttttgaga

SEQ ID NO: 31713 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
gaccctgttaagaaattatt

SEQ ID NO: 31714 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
tgtgatgactttctggaaaa

SEQ ID NO: 31715 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
ctttagggtaataagtcact

SEQ ID NO: 31716 - DNA, 20 bp, Artificial Sequence
  Description of Artificial Sequence: Synthetic oligonucleotide
  Target: ATXN1; (-) strand; PAM type: NNNNGHTT; PAM sequence: AAAGGCTT
agcaggcacttcataattga

SEQ ID NO: 31717 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
aaacagacttggttacttat

SEQ ID NO: 31718 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
tttgaactttaatcatctta

SEQ ID NO: 31719 - DNA, 20 bp, Artificial Sequence
  Description of Artificial Sequence: Synthetic oligonucleotide
  Target: ATXN1; (-) strand; PAM type: NNNNGHTT; PAM sequence: GAAAGATT
tgaaaattgtaaacaattat

SEQ ID NO: 31720 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
tttaatacatctatttgctt

SEQ ID NO: 31721 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
ttattatatttaatacatct

SEQ ID NO: 31722 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
gtatatatggatccaaaatt

SEQ ID NO: 31723 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
cttgaaacattgtaatttgg

SEQ ID NO: 31724 - DNA, 20 bp, Artificial Sequence
  Description of Artificial Sequence: Synthetic oligonucleotide
  Target: ATXN1; (-) strand; PAM type: NNNNGHTT; PAM sequence: ATATGATT
agttcctgtttgcatgcatt

SEQ ID NO: 31725 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
tttttaagcactttggaagt

SEQ ID NO: 31726 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
aagagtcagtaataaaggaa

SEQ ID NO: 31727 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
ttagtaatatgtctaagaag

SEQ ID NO: 31728 - DNA, 20 bp, Artificial Sequence
  Description of Artificial Sequence: Synthetic oligonucleotide
  Target: ATXN1; (-) strand; PAM type: NNNNGHTT; PAM sequence: CTCGGCTT
atttttgtgcccactggcat

SEQ ID NO: 31729 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
gcagtctcaagttggtcagt

SEQ ID NO: 31730 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
gtgacctctacagctgccct

SEQ ID NO: 31731 - DNA, 20 bp, Artificial Sequence
  Description of Artificial Sequence: Synthetic oligonucleotide
  Target: ATXN1; (-) strand; PAM type: NNNNGHTT; PAM sequence: AGGCGTTT
tgataaactcagcatgctcc

SEQ ID NO: 31732 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
tgtcatttattgcttcattt

SEQ ID NO: 31733 - DNA, 20 bp, Artificial Sequence
  Description of Artificial Sequence: Synthetic oligonucleotide
  Target: ATXN1; (-) strand; PAM type: NNNNGHTT; PAM sequence: TATTGCTT
gcttatttgatcatgtcatt

SEQ ID NO: 31734 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
cctccccactgccctgtgcg

SEQ ID NO: 31735 - DNA, 20 bp, Artificial Sequence
  Description of Artificial Sequence: Synthetic oligonucleotide
  Target: ATXN1; (-) strand; PAM type: NNNNGHTT; PAM sequence: AGCTGCTT
cgggacggaaagttttcccc

SEQ ID NO: 31736 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
atctccacttctccgggacg

SEQ ID NO: 31737 - DNA, 20 bp, Artificial Sequence
  Description of Artificial Sequence: Synthetic oligonucleotide
  Target: ATXN1; (-) strand; PAM type: NNNNGHTT; PAM sequence: CCCTGCTT
atcctgtttgtttctgacca

SEQ ID NO: 31738 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
atgttgcccatacatatcct

SEQ ID NO: 31739 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
ccagatgttgcccatacata

SEQ ID NO: 31740 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
tgtagaaagggtgggcagaa

SEQ ID NO: 31741 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
atgatattaccattctcctt

SEQ ID NO: 31742 - DNA, 20 bp, Artificial Sequence
  Description of Artificial Sequence: Synthetic oligonucleotide
  Target: ATXN1; (-) strand; PAM type: NNNNGHTT; PAM sequence: TGGGGATT
cagtttcttcatctgaagag

SEQ ID NO: 31743 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
gtccctgaacctatctgtgc

SEQ ID NO: 31744 - DNA, 20 bp, Artificial Sequence
  Description of Artificial Sequence: Synthetic oligonucleotide
  Target: ATXN1; (-) strand; PAM type: NNNNGHTT; PAM sequence: CTAGGCTT
ttccctttgagtcagctcga

SEQ ID NO: 31745 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
tttctcagatgtctgctgtg

SEQ ID NO: 31746 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
caggatttctcagatgtctg

SEQ ID NO: 31747 - DNA, 20 bp, Artificial Sequence
  Description of Artificial Sequence: Synthetic oligonucleotide
  Target: ATXN1; (-) strand; PAM type: NNNNGHTT; PAM sequence: TCAGGATT
attctgtaggaagacttgtt

SEQ ID NO: 31748 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
agtcatcattctgtaggaag

SEQ ID NO: 31749 - DNA, 20 bp, Artificial Sequence
  Description of Artificial Sequence: Synthetic oligonucleotide
  Target: ATXN1; (-) strand; PAM type: NNNNGHTT; PAM sequence: GGATGTTT
atactttgtacagtaaagga

SEQ ID NO: 31750 - DNA, 20 bp, Artificial Sequence
  Description of Artificial Sequence: Synthetic oligonucleotide
  Target: ATXN1; (-) strand; PAM type: NNNNGHTT; PAM sequence: GAACGCTT
acatttcaaagaaagccagc

SEQ ID NO: 31751 - DNA, 20 bp, Artificial Sequence
  Description of Artificial Sequence: Synthetic oligonucleotide
  Target: ATXN1; (-) strand; PAM type: NNNNGHTT; PAM sequence: CCAAGTTT
aaatacaaagccagcagctc

SEQ ID NO: 31752 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
cttgactccggagtcccaga

SEQ ID NO: 31753 - DNA, 20 bp, Artificial Sequence
  Description of Artificial Sequence: Synthetic oligonucleotide
  Target: ATXN1; (-) strand; PAM type: NNNNGHTT; PAM sequence: CAGAGCTT
tacaggctttgaatgttatt

SEQ ID NO: 31754 - DNA, 20 bp, Artificial Sequence
  Description of Artificial Sequence: Synthetic oligonucleotide
  Target: ATXN1; (-) strand; PAM type: NNNNGHTT; PAM sequence: ACAGGCTT
taaaattcgaacgaaagaat

SEQ ID NO: 31755 - DNA, 20 bp, Artificial Sequence
  Description of Artificial Sequence: Synthetic oligonucleotide
  Target: ATXN1; (-) strand; PAM type: NNNNGHTT; PAM sequence: GCTGGATT
acctccatgagggttggatg

SEQ ID NO: 31756 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
ctgttgccatctctgagatg

SEQ ID NO: 31757 - DNA, 20 bp, Artificial Sequence
  Description of Artificial Sequence: Synthetic oligonucleotide
  Target: ATXN1; (-) strand; PAM type: NNNNGHTT; PAM sequence: TGAAGTTT
catcgcgcttggccaatttt

SEQ ID NO: 31758 - DNA, 20 bp, Artificial Sequence
  Description of Artificial Sequence: Synthetic oligonucleotide
  Target: ATXN1; (-) strand; PAM type: NNNNGHTT; PAM sequence: TCGCGCTT
gggattacaggcgtgcgcca

SEQ ID NO: 31759 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaaattg

SEQ ID NO: 31760 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
ttttgtatttttagtagaga

SEQ ID NO: 31761 - DNA, 20 bp, Artificial Sequence
  Description of Artificial Sequence: Synthetic oligonucleotide
  Target: ATXN1; (-) strand; PAM type: NNNNGHTT; PAM sequence: TAGAGATT
actaatttttgtatttttag

SEQ ID NO: 31762 - DNA, 20 bp, Artificial Sequence
  Description of Artificial Sequence: Synthetic oligonucleotide
  Target: ATXN1; (-) strand; PAM type: NNNNGHTT; PAM sequence: AGGTGATT
aatgtccatctcccgggttc

SEQ ID NO: 31763 - DNA, 20 bp, Artificial Sequence
  Description of Artificial Sequence: Synthetic oligonucleotide
  Target: ATXN1; (-) strand; PAM type: NNNNGHTT; PAM sequence: AAGGGATT
ttccctaacttctacctata

SEQ ID NO: 31764 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
tgttttaccctttaactcca

SEQ ID NO: 31765 - DNA, 20 bp, Artificial Sequence
  Description of Artificial Sequence: Synthetic oligonucleotide
  Target: ATXN1; (-) strand; PAM type: NNNNGHTT; PAM sequence: TACTGTTT
tatatatatatatatataca

SEQ ID NO: 31766 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
cttttgaaagatatgtgtgg

SEQ ID NO: 31767 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
tttaacttctttatgcttca

SEQ ID NO: 31768 - DNA, 20 bp, Artificial Sequence
  Description of Artificial Sequence: Synthetic oligonucleotide
  Target: ATXN1; (-) strand; PAM type: NNNNGHTT; PAM sequence: TTATGCTT
ataaatcatgtttaacttct

SEQ ID NO: 31769 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
gaaatttgacctggaataaa

SEQ ID NO: 31770 - DNA, 20 bp, Artificial Sequence
  Description of Artificial Sequence: Synthetic oligonucleotide
  Target: ATXN1; (-) strand; PAM type: NNNNGHTT; PAM sequence: TATGGCTT
gcaagaggaaggtctgtatt

SEQ ID NO: 31771 - DNA, 20 bp, Artificial Sequence
  Description of Artificial Sequence: Synthetic oligonucleotide
  Target: ATXN1; (-) strand; PAM type: NNNNGHTT; PAM sequence: CCAAGCTT
gcaacgttaatgacatttgt

SEQ ID NO: 31772 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
cagttatacagtgtctttca

SEQ ID NO: 31773 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
cacaaactgcttctcgtgga

SEQ ID NO: 31774 - DNA, 20 bp, Artificial Sequence
  Description of Artificial Sequence: Synthetic oligonucleotide
  Target: ATXN1; (-) strand; PAM type: NNNNGHTT; PAM sequence: CGTGGATT
tttttgcacaaactgcttct

SEQ ID NO: 31775 - DNA, 20 bp, Artificial Sequence
  Description of Artificial Sequence: Synthetic oligonucleotide
  Target: ATXN1; (-) strand; PAM type: NNNNGHTT; PAM sequence: AACTGCTT
gagcattttttttttgcaca

SEQ ID NO: 31776 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
tatcttagaacggggtctag

SEQ ID NO: 31777 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
tcattgcagctcagtgcttg

SEQ ID NO: 31778 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
cctcatttctcattgcagct

SEQ ID NO: 31779 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
tctgtctaatctgcacatgc

SEQ ID NO: 31780 - DNA, 20 bp, Artificial Sequence
  Description of Artificial Sequence: Synthetic oligonucleotide
  Target: ATXN1; (-) strand; PAM type: NNNNGHTT; PAM sequence: ACATGCTT
tcgttatctgtctaatctgc

SEQ ID NO: 31781 - DNA, 20 bp, Artificial Sequence
  Description of Artificial Sequence: Synthetic oligonucleotide
  Target: ATXN1; (-) strand; PAM type: NNNNGHTT; PAM sequence: CTCCGTTT
ctgaaagcaagaggaatgac

SEQ ID NO: 31782 - DNA, 20 bp, Artificial Sequence
  Description of Artificial Sequence: Synthetic oligonucleotide
  Target: ATXN1; (-) strand; PAM type: NNNNGHTT; PAM sequence: TCTGGTTT
gccttgcagcccttggtcgc

SEQ ID NO: 31783 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
agcaaagtacagacaacttc

SEQ ID NO: 31784 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
tatcatggggaaaaatgccc

SEQ ID NO: 31785 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
atattgaacactaatactga

SEQ ID NO: 31786 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
aatagcacaggaaatgtgta

SEQ ID NO: 31787 - DNA, 20 bp, Artificial Sequence
  Description of Artificial Sequence: Synthetic oligonucleotide
  Target: ATXN1; (-) strand; PAM type: NNNNGHTT; PAM sequence: GGGTGCTT
ttagagcaaataattgctta

SEQ ID NO: 31788 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
tttaatactttagagcaaat

SEQ ID NO: 31789 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
tggcaccagctaagaaaatt

SEQ ID NO: 31790 - DNA, 20 bp, Artificial Sequence
  Description of Artificial Sequence: Synthetic oligonucleotide
  Target: ATXN1; (-) strand; PAM type: NNNNGHTT; PAM sequence: CCGTGTTT
gagtgttgccggtttaaaag

SEQ ID NO: 31791 - DNA, 20 bp, Artificial Sequence
  Description of Artificial Sequence: Synthetic oligonucleotide
  Target: ATXN1; (-) strand; PAM type: NNNNGHTT; PAM sequence: GCCGGTTT
gcaaatgtagcatgagtgtt

SEQ ID NO: 31792 - DNA, 20 bp, Artificial Sequence
  Description of Artificial Sequence: Synthetic oligonucleotide
  Target: ATXN1; (-) strand; PAM type: NNNNGHTT; PAM sequence: TAAAGCTT
gaaagactacagtgtgccta

SEQ ID NO: 31793 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
ttttatgttctatctcatct

SEQ ID NO: 31794 - DNA, 20 bp, Artificial Sequence
  Description of Artificial Sequence: Synthetic oligonucleotide
  Target: ATXN1; (-) strand; PAM type: NNNNGHTT; PAM sequence: ATGAGATT
taacaccaagcagtataacg

SEQ ID NO: 31795 - DNA, 20 bp, Artificial Sequence
  Description of Artificial Sequence: Synthetic oligonucleotide
  Target: ATXN1; (-) strand; PAM type: NNNNGHTT; PAM sequence: TCATGATT
ggagtgatattttccaatgg

SEQ ID NO: 31796 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcggcctcctaaagtg

SEQ ID NO: 31797 - DNA, 20 bp, Artificial Sequence
  Description of Artificial Sequence: Synthetic oligonucleotide
  Target: ATXN1; (-) strand; PAM type: NNNNGHTT; PAM sequence: CGGGGTTT
ttttgtattttcagtagaga

SEQ ID NO: 31798 - DNA, 20 bp, Artificial Sequence
  Description of Artificial Sequence: Synthetic oligonucleotide
  Target: ATXN1; (-) strand; PAM type: NNNNGHTT; PAM sequence: CTCGGCTT
cttgagtggagtggtgccat

SEQ ID NO: 31799 - DNA, 20 bp, Artificial Sequence
  Description of Artificial Sequence: Synthetic oligonucleotide
  Target: ATXN1; (-) strand; PAM type: NNNNGHTT; PAM sequence: GAGTGATT
atttggagctttatcaaatg

SEQ ID NO: 31800 - DNA, 20 bp, Artificial Sequence
  Description of Artificial Sequence: Synthetic oligonucleotide
  Target: ATXN1; (-) strand; PAM type: NNNNGHTT; PAM sequence: TGGAGCTT
ttttatcagctattatgatt

SEQ ID NO: 31801 - DNA, 20 bp, Artificial Sequence
  Description of Artificial Sequence: Synthetic oligonucleotide
  Target: ATXN1; (-) strand; PAM type: NNNNGHTT; PAM sequence: TTATGATT
ggggactcttttatcagcta

SEQ ID NO: 31802 - DNA, 20 bp, Artificial Sequence
  Description of Artificial Sequence: Synthetic oligonucleotide
  Target: ATXN1; (-) strand; PAM type: NNNNGHTT; PAM sequence: GGTTGCTT
tatttacatatgtatgtttt

SEQ ID NO: 31803 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
ctttgcacatatttacatat

SEQ ID NO: 31804 - DNA, 20 bp, Artificial Sequence
  Description of Artificial Sequence: Synthetic oligonucleotide
  Target: ATXN1; (-) strand; PAM type: NNNNGHTT; PAM sequence: AAAAGATT
aaaaacatgtaatgaagcta

SEQ ID NO: 31805 - DNA, 20 bp, Artificial Sequence
  Description of Artificial Sequence: Synthetic oligonucleotide
  Target: ATXN1; (-) strand; PAM type: NNNNGHTT; PAM sequence: TTAGGATT
tttaatgcagtcttagctgt

SEQ ID NO: 31806 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
tggcaatttaatgcagtctt

SEQ ID NO: 31807 - DNA, 20 bp, Artificial Sequence
  Description of Artificial Sequence: Synthetic oligonucleotide
  Target: ATXN1; (-) strand; PAM type: NNNNGHTT; PAM sequence: GGAAGTTT
tgcaaattgcactcatccat

SEQ ID NO: 31808 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
aaaaaataggtaaagaggct

SEQ ID NO: 31809 - DNA, 20 bp, Artificial Sequence
  Description of Artificial Sequence: Synthetic oligonucleotide
  Target: ATXN1; (-) strand; PAM type: NNNNGHTT; PAM sequence: AGAGGCTT
tacatttaaaaaataggtaa

SEQ ID NO: 31810 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
attctttcatcggttggaaa

SEQ ID NO: 31811 - DNA, 20 bp, Artificial Sequence
  Description of Artificial Sequence: Synthetic oligonucleotide
  Target: ATXN1; (-) strand; PAM type: NNNNGHTT; PAM sequence: GCAGGCTT
ttgtcccttaatgctttaat

SEQ ID NO: 31812 - DNA, 20 bp, Artificial Sequence
  Description of Artificial Sequence: Synthetic oligonucleotide
  Target: ATXN1; (-) strand; PAM type: NNNNGHTT; PAM sequence: TAATGCTT
gtaaccttgttgttgtccct

SEQ ID NO: 31813 - DNA, 20 bp, Artificial Sequence
  Description of Artificial Sequence: Synthetic oligonucleotide
  Target: ATXN1; (-) strand; PAM type: NNNNGHTT; PAM sequence: TTGGGATT
cgcctcggcctcccaaagtg

SEQ ID NO: 31814 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
acagggtcttgctatgttgc

SEQ ID NO: 31815 - DNA, 20 bp, Artificial Sequence
  Description of Artificial Sequence: Synthetic oligonucleotide
  Target: ATXN1; (-) strand; PAM type: NNNNGHTT; PAM sequence: TCCCGATT
gtgatcctcctacctcagcc

SEQ ID NO: 31816 - DNA, 20 bp, Artificial Sequence
  Description of Artificial Sequence: Synthetic oligonucleotide
  Target: ATXN1; (-) strand; PAM type: NNNNGHTT; PAM sequence: CACAGCTT
ctggagtgcagtggcatgat

SEQ ID NO: 31817 - DNA, 20 bp, Artificial Sequence
  Description of Artificial Sequence: Synthetic oligonucleotide
  Target: ATXN1; (-) strand; PAM type: NNNNGHTT; PAM sequence: GCCTGTTT
ggtgtgaaccaccatgcctg

SEQ ID NO: 31818 - DNA, 20 bp, Artificial Sequence
  Description of Artificial Sequence: Synthetic oligonucleotide
  Target: ATXN1; (-) strand; PAM type: NNNNGHTT; PAM sequence: CCGGGATT
gacctcggcctcccaaagta

SEQ ID NO: 31819 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
ttttgtatttttagtcaaga

SEQ ID NO: 31820 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
tgcctcagcctcccaagtag

SEQ ID NO: 31821 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
aacctctccctcccggattc

SEQ ID NO: 31822 - DNA, 20 bp, Artificial Sequence
  Description of Artificial Sequence: Synthetic oligonucleotide
  Target: ATXN1; (-) strand; PAM type: NNNNGHTT; PAM sequence: CCCGGATT
gctcactgtaacctctccct

SEQ ID NO: 31823 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
tggttctttttcatttgaga

SEQ ID NO: 31824 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
taccttggcctcccaaagtg

SEQ ID NO: 31825 - DNA, 20 bp, Artificial Sequence
  Description of Artificial Sequence: Synthetic oligonucleotide
  Target: ATXN1; (-) strand; PAM type: NNNNGHTT; PAM sequence: GCTGGTTT
ggtttcaccatgttggccag

SEQ ID NO: 31826 - DNA, 20 bp, Artificial Sequence
  Description of Artificial Sequence: Synthetic oligonucleotide
  Target: ATXN1; (-) strand; PAM type: NNNNGHTT; PAM sequence: TGGGGTTT
gcgtcagcctccggagtggc

SEQ ID NO: 31827 - DNA, 20 bp, Artificial Sequence
  Description of Artificial Sequence: Synthetic oligonucleotide
  Target: ATXN1; (-) strand; PAM type: NNNNGHTT; PAM sequence: AAGCGATT
aatctccgcctcttgggttc

SEQ ID NO: 31828 - DNA, 20 bp, Artificial Sequence
  Description of Artificial Sequence: Synthetic oligonucleotide
  Target: ATXN1; (-) strand; PAM type: NNNNGHTT; PAM sequence: ACAAGCTT
actgtgccaacagatctctc

SEQ ID NO: 31829 - DNA, 20 bp, Artificial Sequence
  Description of Artificial Sequence: Synthetic oligonucleotide
  Target: ATXN1; (-) strand; PAM type: NNNNGHTT; PAM sequence: GGATGATT
gcaaacagaacacctgagaa

SEQ ID NO: 31830 - DNA, 20 bp, Artificial Sequence
  Description of Artificial Sequence: Synthetic oligonucleotide
  Target: ATXN1; (-) strand; PAM type: NNNNGHTT; PAM sequence: CTATGTTT
gcccttccaagtaaagcatg

SEQ ID NO: 31831 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tgcacaccagccagatcact

SEQ ID NO: 31832 - DNA, 20 bp, Artificial Sequence
  Description of Artificial Sequence: Synthetic oligonucleotide
  Target: ATXN1; (-) strand; PAM type: NNNNGHTT; PAM sequence: CACTGTTT
aaaatgcacaccagccagat

SEQ ID NO: 31833 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
gaggtcgaggctgcagtgag

SEQ ID NO: 31834 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
tcaggaggctgaggcaggag

SEQ ID NO: 31835 - DNA, 20 bp, Artificial Sequence
  Description of Artificial Sequence: Synthetic oligonucleotide
  Target: ATXN1; (-) strand; PAM type: NNNNGHTT; PAM sequence: GGTGGATT
cactttgagaggccaaggca

SEQ ID NO: 31836 - DNA, 20 bp, Artificial Sequence
  Description of Artificial Sequence: Synthetic oligonucleotide
  Target: ATXN1; (-) strand; PAM type: NNNNGHTT; PAM sequence: TGACGTTT
aaggaaccactatagaaaca

SEQ ID NO: 31837 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
cttgcaaaattatgttcaaa

SEQ ID NO: 31838 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
tgccattttaaccttagacc

SEQ ID NO: 31839 - DNA, 20 bp, Artificial Sequence
  Description of Artificial Sequence: Synthetic oligonucleotide
  Target: ATXN1; (-) strand; PAM type: NNNNGHTT; PAM sequence: CTGGGCTT
agagctagtaagtggtggga

SEQ ID NO: 31840 - DNA, 20 bp, Artificial Sequence
  Description of Artificial Sequence: Synthetic oligonucleotide
  Target: ATXN1; (-) strand; PAM type: NNNNGHTT; PAM sequence: AGTAGCTT
acagatgaggtaaccgggtt

SEQ ID NO: 31841 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
ataatggctggctggcatat

SEQ ID NO: 31842 - DNA, 20 bp, Artificial Sequence
  Description of Artificial Sequence: Synthetic oligonucleotide
  Target: ATXN1; (-) strand; PAM type: NNNNGHTT; PAM sequence: GATAGTTT
aaaagtggaacttgattgct

SEQ ID NO: 31843 - DNA, 20 bp, Artificial Sequence
  Description of Artificial Sequence: Synthetic oligonucleotide
  Target: ATXN1; (-) strand; PAM type: NNNNGHTT; PAM sequence: ACTTGATT
gtggctcttaaaaaagtgga

SEQ ID NO: 31844 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
cttttcttataaaccattag

SEQ ID NO: 31845 - DNA, 20 bp, Artificial Sequence
  Description of Artificial Sequence: Synthetic oligonucleotide
  Target: ATXN1; (-) strand; PAM type: NNNNGHTT; PAM sequence: ATTAGATT
tcacacttttcttataaacc

SEQ ID NO: 31846 - DNA, 20 bp, Artificial Sequence
  Description of Artificial Sequence: Synthetic oligonucleotide
  Target: ATXN1; (-) strand; PAM type: NNNNGHTT; PAM sequence: TTCAGATT
cctgaaagggttcctggata

SEQ ID NO: 31847 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
tatatagcagttaatattaa

SEQ ID NO: 31848 - DNA, 20 bp, Artificial Sequence
  Description of Artificial Sequence: Synthetic oligonucleotide
  Target: ATXN1; (-) strand; PAM type: NNNNGHTT; PAM sequence: GCTGGATT
tcttcatactttaaattact

SEQ ID NO: 31849 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
aagagttaagtggatcttcc

SEQ ID NO: 31850 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
tttttttgtattatttgagg

SEQ ID NO: 31851 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
attaatctttgattactctt

SEQ ID NO: 31852 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
atggtttcaaacagattaat

SEQ ID NO: 31853 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
agttgtggcccatggtttca

SEQ ID NO: 31854 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
atgcggaataagttgtggcc

SEQ ID NO: 31855 - DNA, 20 bp, Artificial Sequence
  Description of Artificial Sequence: Synthetic oligonucleotide
  Target: ATXN1; (-) strand; PAM type: NNNNGHTT; PAM sequence: GGCAGTTT
aataacagtttgagtattta

SEQ ID NO: 31856 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
gaatatcagctataatcaat

SEQ ID NO: 31857 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
attaatgtatcagtgaattc

SEQ ID NO: 31858 - DNA, 20 bp, Artificial Sequence
  Description of Artificial Sequence: Synthetic oligonucleotide
  Target: ATXN1; (-) strand; PAM type: NNNNGHTT; PAM sequence: TGTAGATT
ttaaacactgaaatcaaagc

SEQ ID NO: 31859 - DNA, 20 bp, Artificial Sequence
  Description of Artificial Sequence: Synthetic oligonucleotide
  Target: ATXN1; (-) strand; PAM type: NNNNGHTT; PAM sequence: TTATGTTT
tcccaaagttgtcagttcct

SEQ ID NO: 31860 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
tgcccaataaatacactgaa

SEQ ID NO: 31861 - DNA, 20 bp, Artificial Sequence
  Description of Artificial Sequence: Synthetic oligonucleotide
  Target: ATXN1; (-) strand; PAM type: NNNNGHTT; PAM sequence: GGTTGATT
tgaaaagctctttattttaa

SEQ ID NO: 31862 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
tgtacagctatgatacaact

SEQ ID NO: 31863 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
tcagtatctcataaaatata

SEQ ID NO: 31864 - DNA, 20 bp, Artificial Sequence
  Description of Artificial Sequence: Synthetic oligonucleotide
  Target: ATXN1; (-) strand; PAM type: NNNNGHTT; PAM sequence: ATTGGATT
gacaggaatttaatccttca

SEQ ID NO: 31865 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
tacgtgcagacacatgagtg

SEQ ID NO: 31866 - DNA, 20 bp, Artificial Sequence
  Description of Artificial Sequence: Synthetic oligonucleotide
  Target: ATXN1; (-) strand; PAM type: NNNNGHTT; PAM sequence: AGGGGATT
ggaatttctgctctctggaa

SEQ ID NO: 31867 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
tctatttcagtttgaagtgt

SEQ ID NO: 31868 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
cgaaatgctgatgaatctat

SEQ ID NO: 31869 - DNA, 20 bp, Artificial Sequence
  Description of Artificial Sequence: Synthetic oligonucleotide
  Target: ATXN1; (-) strand; PAM type: NNNNGHTT; PAM sequence: AATGGCTT
acttacaaataacctttgct

SEQ ID NO: 31870 - DNA, 20 bp, Artificial Sequence
  Description of Artificial Sequence: Synthetic oligonucleotide
  Target: ATXN1; (-) strand; PAM type: NNNNGHTT; PAM sequence: TCTTGATT
gactttgaaatctttatgtc

SEQ ID NO: 31871 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
ttttgcttttctctctgact

SEQ ID NO: 31872 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tgaaggagcaatgatcttgc

SEQ ID NO: 31873 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
tctctgtgaaggagcaatga

SEQ ID NO: 31874 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
ggaaacaggaaagcaaatcc

SEQ ID NO: 31875 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
cgtaattcattgctttgaag

SEQ ID NO: 31876 - DNA, 20 bp, Artificial Sequence
  Description of Artificial Sequence: Synthetic oligonucleotide
  Target: ATXN1; (-) strand; PAM type: NNNNGHTT; PAM sequence: GAAGGTTT
tatgcgtaattcattgcttt

SEQ ID NO: 31877 - DNA, 20 bp, Artificial Sequence
  Description of Artificial Sequence: Synthetic oligonucleotide
  Target: ATXN1; (-) strand; PAM type: NNNNGHTT; PAM sequence: CATTGCTT
ctgtgtgtctatgcgtaatt

SEQ ID NO: 31878 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
tttcacgatatttaaatagc

SEQ ID NO: 31879 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
ccaaataattaaaaatagag

SEQ ID NO: 31880 - DNA, 20 bp, Artificial Sequence
  Description of Artificial Sequence: Synthetic oligonucleotide
  Target: ATXN1; (-) strand; PAM type: NNNNGHTT; PAM sequence: TTAAGCTT
cactagctgtttaaaaataa

SEQ ID NO: 31881 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
atggtttacaatattacact

SEQ ID NO: 31882 - DNA, 20 bp, Artificial Sequence
  Description of Artificial Sequence: Synthetic oligonucleotide
  Target: ATXN1; (-) strand; PAM type: NNNNGHTT; PAM sequence: CATGGTTT
acaaattagttgtctctaca

SEQ ID NO: 31883 - DNA, 20 bp, Artificial Sequence
  Description of Artificial Sequence: Synthetic oligonucleotide
  Target: ATXN1; (-) strand; PAM type: NNNNGHTT; PAM sequence: TACAGCTT
tttctgttcttcatacaccc

SEQ ID NO: 31884 - DNA, 20 bp, Artificial Sequence
  Description of Artificial Sequence: Synthetic oligonucleotide
  Target: ATXN1; (-) strand; PAM type: NNNNGHTT; PAM sequence: CTTGGATT
gcatcacttactaaagttcc

SEQ ID NO: 31885 - DNA, 20 bp, Artificial Sequence
  Description of Artificial Sequence: Synthetic oligonucleotide
  Target: ATXN1; (-) strand; PAM type: NNNNGHTT; PAM sequence: ATGAGATT
atgaaaatctatttgtcatt

SEQ ID NO: 31886 - DNA, 20 bp, Artificial Sequence
  Description of Artificial Sequence: Synthetic oligonucleotide
  Target: ATXN1; (-) strand; PAM type: NNNNGHTT; PAM sequence: ATGAGATT
aactgaaacttctcctgcta

SEQ ID NO: 31887 - DNA, 20 bp, Artificial Sequence
  Description of Artificial Sequence: Synthetic oligonucleotide
  Target: ATXN1; (-) strand; PAM type: NNNNGHTT; PAM sequence: CTGTGCTT
cttgcatctgagtccatttc

SEQ ID NO: 31888 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
gttattctgaatattatggc

SEQ ID NO: 31889 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
cttctctttctacttctctt

SEQ ID NO: 31890 - DNA, 20 bp, Artificial Sequence
  Description of Artificial Sequence: Synthetic oligonucleotide
  Target: ATXN1; (-) strand; PAM type: NNNNGHTT; PAM sequence: CATCGCTT
tttctgtcttattgctgaac

SEQ ID NO: 31891 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
ccaaacagttccaacctgtt

SEQ ID NO: 31892 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tacttagaaactactttttt

SEQ ID NO: 31893 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
actaatttgctacttgggtt

SEQ ID NO: 31894 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
gtttataactaatttgctac

SEQ ID NO: 31895 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
ccgtctattttgttttcttt

SEQ ID NO: 31896 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tcttaactggatgccgtcta

SEQ ID NO: 31897 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
tctgttaggttttagcccta

SEQ ID NO: 31898 - DNA, 20 bp, Artificial Sequence
  Description of Artificial Sequence: Synthetic oligonucleotide
  Target: ATXN1; (-) strand; PAM type: NNNNGHTT; PAM sequence: TTAGGTTT
tctcgaggaataaagttctg

SEQ ID NO: 31899 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
tttagggctattgatcaaga

SEQ ID NO: 31900 - DNA, 20 bp, Artificial Sequence
  Description of Artificial Sequence: Synthetic oligonucleotide
  Target: ATXN1; (-) strand; PAM type: NNNNGHTT; PAM sequence: TGAGGTTT
ctgtatgattcagtagactc

SEQ ID NO: 31901 - DNA, 20 bp, Artificial Sequence
  Description of Artificial Sequence: Synthetic oligonucleotide
  Target: ATXN1; (-) strand; PAM type: NNNNGHTT; PAM sequence: GTATGATT
attttggctcttcgtggcct

SEQ ID NO: 31902 - DNA, 20 bp, Artificial Sequence
  Description of Artificial Sequence: Synthetic oligonucleotide
  Target: ATXN1; (-) strand; PAM type: NNNNGHTT; PAM sequence: CCTGGATT
cagatcattctggcattggt

SEQ ID NO: 31903 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
attaggtgtttattgttttg

SEQ ID NO: 31904 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
gagaaattaggtgtttattg

SEQ ID NO: 31905 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
tcaaggagaaattaggtgtt

SEQ ID NO: 31906 - DNA, 20 bp, Artificial Sequence
  Description of Artificial Sequence: Synthetic oligonucleotide
  Target: ATXN1; (-) strand; PAM type: NNNNGHTT; PAM sequence: AGGTGTTT
actctcctcaaggagaaatt

SEQ ID NO: 31907 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
agagcccccagcaaaggaag

SEQ ID NO: 31908 - DNA, 20 bp, Artificial Sequence
  Description of Artificial Sequence: Synthetic oligonucleotide
  Target: ATXN1; (-) strand; PAM type: NNNNGHTT; PAM sequence: CTGAGCTT
agtgttagcggtttaaggaa

SEQ ID NO: 31909 - DNA, 20 bp, Artificial Sequence
  Description of Artificial Sequence: Synthetic oligonucleotide
  Target: ATXN1; (-) strand; PAM type: NNNNGHTT; PAM sequence: AGCGGTTT
gaaagctaatagccagtgtt

SEQ ID NO: 31910 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
ctcctcatgatggctccctg

SEQ ID NO: 31911 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
ctttattttggactttctga

SEQ ID NO: 31912 - DNA, 20 bp, Artificial Sequence
  Description of Artificial Sequence: Synthetic oligonucleotide
  Target: ATXN1; (-) strand; PAM type: NNNNGHTT; PAM sequence: CCTGGTTT
agatgtgctttttttaaaat

SEQ ID NO: 31913 - DNA, 20 bp, Artificial Sequence
  Description of Artificial Sequence: Synthetic oligonucleotide
  Target: ATXN1; (-) strand; PAM type: NNNNGHTT; PAM sequence: ATGTGCTT
tataaataattcagtcatag

SEQ ID NO: 31914 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
catgtttacatatcttatag

SEQ ID NO: 31915 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
tcacttaaagaaaattgaat

SEQ ID NO: 31916 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
tcttgttctgacaaccatat

SEQ ID NO: 31917 - DNA, 20 bp, Artificial Sequence
  Description of Artificial Sequence: Synthetic oligonucleotide
  Target: ATXN1; (-) strand; PAM type: NNNNGHTT; PAM sequence: AATAGCTT
acagcaattgattcaagttg

SEQ ID NO: 31918 - DNA, 20 bp, Artificial Sequence
  Description of Artificial Sequence: Synthetic oligonucleotide
  Target: ATXN1; (-) strand; PAM type: NNNNGHTT; PAM sequence: AATTGATT
tattggagaatggatacagc

SEQ ID NO: 31919 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
cacaaccaaaatgtatatat

SEQ ID NO: 31920 - DNA, 20 bp, Artificial Sequence
  Description of Artificial Sequence: Synthetic oligonucleotide
  Target: ATXN1; (-) strand; PAM type: NNNNGHTT; PAM sequence: CAGGGTTT
gtggtacagaataaaaatgt

SEQ ID NO: 31921 - DNA, 20 bp, Artificial Sequence
  Description of Artificial Sequence: Synthetic oligonucleotide
  Target: ATXN1; (-) strand; PAM type: NNNNGHTT; PAM sequence: GGGTGCTT
ggcttattttaaaaagttat

SEQ ID NO: 31922 - DNA, 20 bp, Artificial Sequence
  Description of Artificial Sequence: Synthetic oligonucleotide
  Target: ATXN1; (-) strand; PAM type: NNNNGHTT; PAM sequence: CAGGGCTT
ttgatcactgatttaaatag

SEQ ID NO: 31923 - DNA, 20 bp, Artificial Sequence
  Description of Artificial Sequence: Synthetic oligonucleotide
  Target: ATXN1; (-) strand; PAM type: NNNNGHTT; PAM sequence: CACTGATT
agatacaaaaaaaatttgat

SEQ ID NO: 31924 - DNA, 20 bp, Artificial Sequence
  Description of Artificial Sequence: Synthetic oligonucleotide
  Target: ATXN1; (-) strand; PAM type: NNNNGHTT; PAM sequence: TAGTGTTT
gaattttctccctggatttc

SEQ ID NO: 31925 - DNA, 20 bp, Artificial Sequence
  Description of Artificial Sequence: Synthetic oligonucleotide
  Target: ATXN1; (-) strand; PAM type: NNNNGHTT; PAM sequence: CCTGGATT
tggattggaagaattttctc

SEQ ID NO: 31926 - DNA, 20 bp, Artificial Sequence
  Description of Artificial Sequence: Synthetic oligonucleotide
  Target: ATXN1; (-) strand; PAM type: NNNNGHTT; PAM sequence: GTTGGATT
tgtgtaggaatgtgtggatt

SEQ ID NO: 31927 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
attggttttgtgtaggaatg

SEQ ID NO: 31928 - DNA, 20 bp, Artificial Sequence
  Description of Artificial Sequence: Synthetic oligonucleotide
  Target: ATXN1; (-) strand; PAM type: NNNNGHTT; PAM sequence: ATTGGTTT
agcttttaaatactcaagtg

SEQ ID NO: 31929 - DNA, 20 bp, Artificial Sequence
  Description of Artificial Sequence: Synthetic oligonucleotide
  Target: ATXN1; (-) strand; PAM type: NNNNGHTT; PAM sequence: AAGTGATT
gatctagcttttaaatactc

SEQ ID NO: 31930 - DNA, 20 bp, Artificial Sequence
  Description of Artificial Sequence: Synthetic oligonucleotide
  Target: ATXN1; (-) strand; PAM type: NNNNGHTT; PAM sequence: TCTAGCTT
agcctgtctctcgccacaga

SEQ ID NO: 31931 - DNA, 20 bp, Artificial Sequence
  Description of Artificial Sequence: Synthetic oligonucleotide
  Target: ATXN1; (-) strand; PAM type: NNNNGHTT; PAM sequence: ACTTGTTT
gataaattcatcttgcacag

SEQ ID NO: 31932 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
gatgttaaatgttctgcctg

SEQ ID NO: 31933 - DNA, 20 bp, Artificial Sequence
  Description of Artificial Sequence: Synthetic oligonucleotide
  Target: ATXN1; (-) strand; PAM type: NNNNGHTT; PAM sequence: GCCTGATT
aggacgatgttaaatgttct

SEQ ID NO: 31934 - DNA, 20 bp, Artificial Sequence
  Description of Artificial Sequence: Synthetic oligonucleotide
  Target: ATXN1; (-) strand; PAM type: NNNNGHTT; PAM sequence: GCAGGCTT
ccgaccgcttttgagctggc

SEQ ID NO: 31935 - DNA, 20 bp, Artificial Sequence
  Description of Artificial Sequence: Synthetic oligonucleotide
  Target: ATXN1; (-) strand; PAM type: NNNNGHTT; PAM sequence: GACCGCTT
atagtctgacgtctgtttcc

SEQ ID NO: 31936 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
tagctgtcccatagtctgac

SEQ ID NO: 31937 - DNA, 20 bp, Artificial Sequence
  Description of Artificial Sequence: Synthetic oligonucleotide
  Target: ATXN1; (-) strand; PAM type: NNNNGHTT; PAM sequence: CAATGTTT
tggacgacatccctgagaat

SEQ ID NO: 31938 - DNA, 20 bp, Artificial Sequence
  Description of Artificial Sequence: Synthetic oligonucleotide
  Target: ATXN1; (-) strand; PAM type: NNNNGHTT; PAM sequence: CCCAGCTT
ggccaccctaaaggatgaca

SEQ ID NO: 31939 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
cttggtgtctttgccgttca

SEQ ID NO: 31940 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
cttggtgatggagtagctaa

SEQ ID NO: 31941 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
agatacagcctggcagggac

SEQ ID NO: 31942 - DNA, 20 bp, Artificial Sequence
  Description of Artificial Sequence: Synthetic oligonucleotide
  Target: ATXN1; (-) strand; PAM type: NNNNGHTT; PAM sequence: TACAGCTT
ggtgccctcctcaatctctt

SEQ ID NO: 31943 - DNA, 20 bp, Artificial Sequence
  Description of Artificial Sequence: Synthetic oligonucleotide
  Target: ATXN1; (-) strand; PAM type: NNNNGHTT; PAM sequence: GCCAGATT
cacatttagacttgacagaa

SEQ ID NO: 31944 - DNA, 20 bp, Artificial Sequence
  Description of Artificial Sequence: Synthetic oligonucleotide
  Target: ATXN1; (-) strand; PAM type: NNNNGHTT; PAM sequence: ATCTGATT
tagttgcagaaatactcaga

SEQ ID NO: 31945 - DNA, 20 bp, Artificial Sequence
  Description of Artificial Sequence: Synthetic oligonucleotide
  Target: ATXN1; (-) strand; PAM type: NNNNGHTT; PAM sequence: AGTAGTTT
gccttttctttctttgcaga

SEQ ID NO: 31946 - DNA, 20 bp, Artificial Sequence
  Description of Artificial Sequence: Synthetic oligonucleotide
  Target: ATXN1; (-) strand; PAM type: NNNNGHTT; PAM sequence: ATCAGCTT
gctcttccagccacctgtga

SEQ ID NO: 31947 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
ctttctactagatgttacag

SEQ ID NO: 31948 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
ctgagaagtccttgtggatg

SEQ ID NO: 31949 - DNA, 20 bp, Artificial Sequence
  Description of Artificial Sequence: Synthetic oligonucleotide
  Target: ATXN1; (-) strand; PAM type: NNNNGHTT; PAM sequence: TTGAGCTT
cagccactgcacctttaaag

SEQ ID NO: 31950 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
aaacttgatggataaacaga

SEQ ID NO: 31951 - DNA, 20 bp, Artificial Sequence
  Description of Artificial Sequence: Synthetic oligonucleotide
  Target: ATXN1; (-) strand; PAM type: NNNNGHTT; PAM sequence: AGATGTTT
taaataaaaaattatatgtt

SEQ ID NO: 31952 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
gtggctcatgcctcgaatcc

SEQ ID NO: 31953 - DNA, 20 bp, Artificial Sequence
  Description of Artificial Sequence: Synthetic oligonucleotide
  Target: ATXN1; (-) strand; PAM type: NNNNGHTT; PAM sequence: CAGTGCTT
ttcccagttaccccttgaaa

SEQ ID NO: 31954 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
tgtaggatgaaaagacatgt

SEQ ID NO: 31955 - DNA, 20 bp, Artificial Sequence
  Description of Artificial Sequence: Synthetic oligonucleotide
  Target: ATXN1; (-) strand; PAM type: NNNNGHTT; PAM sequence: TTGCGTTT
caagataccccagaaattat

SEQ ID NO: 31956 - DNA, 20 bp, Artificial Sequence
  Description of Artificial Sequence: Synthetic oligonucleotide
  Target: ATXN1; (-) strand; PAM type: NNNNGHTT; PAM sequence: ACCTGATT
acatgtagcctgtgctgtaa

SEQ ID NO: 31957 - DNA, 20 bp, Artificial Sequence
  Description of Artificial Sequence: Synthetic oligonucleotide
  Target: ATXN1; (-) strand; PAM type: NNNNGHTT; PAM sequence: ACTAGATT
cctacgaggttgactgattt

SEQ ID NO: 31958 - DNA, 20 bp, Artificial Sequence
  Description of Artificial Sequence: Synthetic oligonucleotide
  Target: ATXN1; (-) strand; PAM type: NNNNGHTT; PAM sequence: GACTGATT
aaaacagaacctacgaggtt

SEQ ID NO: 31959 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
tttcagtggatagtcataat

SEQ ID NO: 31960 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
aattcagagtgccttagata

SEQ ID NO: 31961 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
tggtattctgcagtctgagc

SEQ ID NO: 31962 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
tgggaggaaagtcctgtgtt

SEQ ID NO: 31963 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
agtatactgggaggaaagtc

SEQ ID NO: 31964 - DNA, 20 bp, Artificial Sequence
  Description of Artificial Sequence: Synthetic oligonucleotide
  Target: ATXN1; (-) strand; PAM type: NNNNGHTT; PAM sequence: CAAAGTTT
cattcggtgacctgaaatcg

SEQ ID NO: 31965 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
tcatctttaagtcctggagg

SEQ ID NO: 31966 - DNA, 20 bp, Artificial Sequence
  Description of Artificial Sequence: Synthetic oligonucleotide
  Target: ATXN1; (-) strand; PAM type: NNNNGHTT; PAM sequence: TAGTGATT
caaagctgtttcagtcatcc

SEQ ID NO: 31967 - DNA, 20 bp, Artificial Sequence
  Description of Artificial Sequence: Synthetic oligonucleotide
  Target: ATXN1; (-) strand; PAM type: NNNNGHTT; PAM sequence: AGCTGTTT
ttcctcccagcgagctgcaa

SEQ ID NO: 31968 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
gttttattttggctttcctg

SEQ ID NO: 31969 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
cccaaatttcggtgttttat

SEQ ID NO: 31970 - DNA, 20 bp, Artificial Sequence
  Description of Artificial Sequence: Synthetic oligonucleotide
  Target: ATXN1; (-) strand; PAM type: NNNNGHTT; PAM sequence: CGGTGTTT
tggcatctaagcccaaattt

SEQ ID NO: 31971 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
ccatacaactttgctttcta

SEQ ID NO: 31972 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
aaaaatctctttccatacaa

SEQ ID NO: 31973 - DNA, 20 bp, Artificial Sequence
  Description of Artificial Sequence: Synthetic oligonucleotide
  Target: ATXN1; (-) strand; PAM type: NNNNGHTT; PAM sequence: ACAAGTTT
agtggtcatagacccataag

SEQ ID NO: 31974 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
agcagttttgtttggtttga

SEQ ID NO: 31975 - DNA, 20 bp, Artificial Sequence
  Description of Artificial Sequence: Synthetic oligonucleotide
  Target: ATXN1; (-) strand; PAM type: NNNNGHTT; PAM sequence: GTTTGATT
aaagatagcagttttgtttg

SEQ ID NO: 31976 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
ttcaaaagatagcagttttg

SEQ ID NO: 31977 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tacttttcaaaagatagcag

SEQ ID NO: 31978 - DNA, 20 bp, Artificial Sequence
  Description of Artificial Sequence: Synthetic oligonucleotide
  Target: ATXN1; (-) strand; PAM type: NNNNGHTT; PAM sequence: AGCAGTTT
tctgatacttttcaaaagat

SEQ ID NO: 31979 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
agagaagtatgaccccaagt

SEQ ID NO: 31980 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
atgactctggatgaattttg

SEQ ID NO: 31981 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cagaaatgactctggatgaa

SEQ ID NO: 31982 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
accatatgtcagaacctgtt

SEQ ID NO: 31983 - DNA, 20 bp, Artificial Sequence
  Description of Artificial Sequence: Synthetic oligonucleotide
  Target: ATXN1; (-) strand; PAM type: NNNNGHTT; PAM sequence: AACTGCTT
aggtaccacatggaaaggag

SEQ ID NO: 31984 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
gttctaagtgaggttggttg

SEQ ID NO: 31985 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
tcatactctgcaactcaggt

SEQ ID NO: 31986 - DNA, 20 bp, Artificial Sequence
  Description of Artificial Sequence: Synthetic oligonucleotide
  Target: ATXN1; (-) strand; PAM type: NNNNGHTT; PAM sequence: ATCTGTTT
ttgaggttcacgttcttaac

SEQ ID NO: 31987 - DNA, 20 bp, Artificial Sequence
  Description of Artificial Sequence: Synthetic oligonucleotide
  Target: ATXN1; (-) strand; PAM type: NNNNGHTT; PAM sequence: TGAAGATT
cctactgaatttcgattata

SEQ ID NO: 31988 - DNA, 20 bp, Artificial Sequence
  Description of Artificial Sequence: Synthetic oligonucleotide
  Target: ATXN1; (-) strand; PAM type: NNNNGHTT; PAM sequence: TTTCGATT
ttgaaaaaattcctactgaa

SEQ ID NO: 31989 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
attcaatacaggaaaaatgc

SEQ ID NO: 31990 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
attgaaattcaatacaggaa

SEQ ID NO: 31991 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
ctgaattcgctcaatcatat

SEQ ID NO: 31992 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
acctgtttgttccactggct

SEQ ID NO: 31993 - DNA, 20 bp, Artificial Sequence
  Description of Artificial Sequence: Synthetic oligonucleotide
  Target: ATXN1; (-) strand; PAM type: NNNNGHTT; PAM sequence: ACTGGCTT
ctatggcacctgtttgttcc

SEQ ID NO: 31994 - DNA, 20 bp, Artificial Sequence
  Description of Artificial Sequence: Synthetic oligonucleotide
  Target: ATXN1; (-) strand; PAM type: NNNNGHTT; PAM sequence: ACCTGTTT
gtggtggaaaaagctatggc

SEQ ID NO: 31995 - DNA, 20 bp, Artificial Sequence
  Description of Artificial Sequence: Synthetic oligonucleotide
  Target: ATXN1; (-) strand; PAM type: NNNNGHTT; PAM sequence: ATGTGATT
atgcttatgttacaaattgg

SEQ ID NO: 31996 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
acatacgggcattccccctg

SEQ ID NO: 31997 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
ctttccctcattcttgaaat

SEQ ID NO: 31998 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
ttcctccttcaagtgccata

SEQ ID NO: 31999 - DNA, 20 bp, Artificial Sequence
  Description of Artificial Sequence: Synthetic oligonucleotide
  Target: ATXN1; (-) strand; PAM type: NNNNGHTT; PAM sequence: ATAGGTTT
agaatccttagcctggctcc

SEQ ID NO: 32000 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
tatttgaaatctgctgacat

SEQ ID NO: 32001 - DNA, 20 bp, Artificial Sequence
  Description of Artificial Sequence: Synthetic oligonucleotide
  Target: ATXN1; (-) strand; PAM type: NNNNGHTT; PAM sequence: ACATGTTT
tgtattgttgttctggtcca

SEQ ID NO: 32002 - DNA, 20 bp, Artificial Sequence
  Description of Artificial Sequence: Synthetic oligonucleotide
  Target: ATXN1; (-) strand; PAM type: NNNNGHTT; PAM sequence: GGTGGTTT
gagtggctctgctgagctgg

SEQ ID NO: 32003 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
aggaaggctggtctcaaagt

SEQ ID NO: 32004 - DNA, 20 bp, Artificial Sequence
  Description of Artificial Sequence: Synthetic oligonucleotide
  Target: ATXN1; (-) strand; PAM type: NNNNGHTT; PAM sequence: TAGGGATT
gaaggttgggaacaacttcc

SEQ ID NO: 32005 - DNA, 20 bp, Artificial Sequence
  Description of Artificial Sequence: Synthetic oligonucleotide
  Target: ATXN1; (-) strand; PAM type: NNNNGHTT; PAM sequence: CCCTGATT
accagagaggcacgatgcta

SEQ ID NO: 32006 - DNA, 20 bp, Artificial Sequence
  Description of Artificial Sequence: Synthetic oligonucleotide
  Target: ATXN1; (-) strand; PAM type: NNNNGHTT; PAM sequence: GCTGGTTT
taaggaatgggctccttggc

SEQ ID NO: 32007 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
caaccctccgttgctgacct

SEQ ID NO: 32008 - DNA, 20 bp, Artificial Sequence
  Description of Artificial Sequence: Synthetic oligonucleotide
  Target: ATXN1; (-) strand; PAM type: NNNNGHTT; PAM sequence: GCCGGTTT
ttgattctcacccaccctgt

SEQ ID NO: 32009 - DNA, 20 bp, Artificial Sequence
  Description of Artificial Sequence: Synthetic oligonucleotide
  Target: ATXN1; (-) strand; PAM type: NNNNGHTT; PAM sequence: CCTTGATT
tctcccacctgcccctcact

SEQ ID NO: 32010 - DNA, 20 bp, Artificial Sequence
  Description of Artificial Sequence: Synthetic oligonucleotide
  Target: ATXN1; (-) strand; PAM type: NNNNGHTT; PAM sequence: AACTGTTT
tgctcacttttccccttggg

SEQ ID NO: 32011 - DNA, 20 bp, Artificial Sequence
  Description of Artificial Sequence: Synthetic oligonucleotide
  Target: ATXN1; (-) strand; PAM type: NNNNGHTT; PAM sequence: GATGGCTT
ggctggcgagtggtccactg

SEQ ID NO: 32012 - DNA, 20 bp, Artificial Sequence
  Description of Artificial Sequence: Synthetic oligonucleotide
  Target: ATXN1; (-) strand; PAM type: NNNNGHTT; PAM sequence: ATGAGATT
ggccaacctggcaggaataa

SEQ ID NO: 32013 - DNA, 20 bp, Artificial Sequence
  Description of Artificial Sequence: Synthetic oligonucleotide
  Target: ATXN1; (-) strand; PAM type: NNNNGHTT; PAM sequence: TCAAGTTT
gctttttgttgtacaacggt

SEQ ID NO: 32014 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
gtgtcctttcatttcagtga

SEQ ID NO: 32015 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
caattagcaaatggaagtct

SEQ ID NO: 32016 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
cagagatggaacatttccat

SEQ ID NO: 32017 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
tttaataggctctttggttt

SEQ ID NO: 32018 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
ttggctaatttaataggctc

SEQ ID NO: 32019 - DNA, 20 bp, Artificial Sequence
  Description of Artificial Sequence: Synthetic oligonucleotide
  Target: ATXN1; (-) strand; PAM type: NNNNGHTT; PAM sequence: TCTAGCTT
actaatgatataagaatgtc

SEQ ID NO: 32020 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
gttagagggagcttgctctg

SEQ ID NO: 32021 - DNA, 20 bp, Artificial Sequence
  Description of Artificial Sequence: Synthetic oligonucleotide
  Target: ATXN1; (-) strand; PAM type: NNNNGHTT; PAM sequence: GGGAGCTT
aggctcaatactaagttaga

SEQ ID NO: 32022 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
tggacattcgagttgtttct

SEQ ID NO: 32023 - DNA, 20 bp, Artificial Sequence
  Description of Artificial Sequence: Synthetic oligonucleotide
  Target: ATXN1; (-) strand; PAM type: NNNNGHTT; PAM sequence: AGTTGTTT
ctatcatttttggacattcg

SEQ ID NO: 32024 - DNA, 20 bp, Artificial Sequence
  Description of Artificial Sequence: Synthetic oligonucleotide
  Target: ATXN1; (-) strand; PAM type: NNNNGHTT; PAM sequence: TTAAGTTT
aggttgttttatcttaattt

SEQ ID NO: 32025 - DNA, 20 bp, Artificial Sequence
  Description of Artificial Sequence: Synthetic oligonucleotide
  Target: ATXN1; (-) strand; PAM type: NNNNGHTT; PAM sequence: GGTTGTTT
gatcacataacattctatca

SEQ ID NO: 32026 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
cttatatctttttttcagtt

SEQ ID NO: 32027 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gatgtaacttatatcttttt

SEQ ID NO: 32028 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
aaatcaagttcatttttatg

SEQ ID NO: 32029 - DNA, 20 bp, Artificial Sequence
  Description of Artificial Sequence: Synthetic oligonucleotide
  Target: ATXN1; (-) strand; PAM type: NNNNGHTT; PAM sequence: CTTTGATT
ccaataaaagcaaaagttcc

SEQ ID NO: 32030 - DNA, 20 bp, Artificial Sequence
  Description of Artificial Sequence: Synthetic oligonucleotide
  Target: ATXN1; (-) strand; PAM type: NNNNGHTT; PAM sequence: CCATGTTT
acacatgactgataaaaata

SEQ ID NO: 32031 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
tagctctgctctacagaaaa

SEQ ID NO: 32032 - DNA, 20 bp, Artificial Sequence
  Description of Artificial Sequence: Synthetic oligonucleotide
  Target: ATXN1; (-) strand; PAM type: NNNNGHTT; PAM sequence: TGACGTTT
accctccactaacctggcag

SEQ ID NO: 32033 - DNA, 20 bp, Artificial Sequence
  Description of Artificial Sequence: Synthetic oligonucleotide
  Target: ATXN1; (-) strand; PAM type: NNNNGHTT; PAM sequence: TGACGTTT
accctccactaacctgtcag

SEQ ID NO: 32034 - DNA, 20 bp, Artificial Sequence
  Description of Artificial Sequence: Synthetic oligonucleotide
  Target: ATXN1; (-) strand; PAM type: NNNNGHTT; PAM sequence: CAGAGTTT
gagcagccagttttagtagg

SEQ ID NO: 32035 - DNA, 20 bp, Artificial Sequence
  Description of Artificial Sequence: Synthetic oligonucleotide
  Target: ATXN1; (-) strand; PAM type: NNNNGHTT; PAM sequence: GCCAGTTT
aggaggagcttctcagagca

SEQ ID NO: 32036 - DNA, 20 bp, Artificial Sequence
  Description of Artificial Sequence: Synthetic oligonucleotide
  Target: ATXN1; (-) strand; PAM type: NNNNGHTT; PAM sequence: AGGAGCTT
tgaggtatagtcagggtagg

SEQ ID NO: 32037 - DNA, 20 bp, Artificial Sequence
  Description of Artificial Sequence: Synthetic oligonucleotide
  Target: ATXN1; (-) strand; PAM type: NNNNGHTT; PAM sequence: TGTTGCTT
atgtgcactcactctctaga

SEQ ID NO: 32038 - DNA, 20 bp, Artificial Sequence
  Description of Artificial Sequence: Synthetic oligonucleotide
  Target: ATXN1; (-) strand; PAM type: NNNNGHTT; PAM sequence: GAAAGATT
cctaactcacagaatcactg

SEQ ID NO: 32039 - DNA, 20 bp, Artificial Sequence
  Description of Artificial Sequence: Synthetic oligonucleotide
  Target: ATXN1; (-) strand; PAM type: NNNNGHTT; PAM sequence: CCTGGCTT
gaatccttctggctctggct

SEQ ID NO: 32040 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
ggctttaaagtcagggagat

SEQ ID NO: 32041 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
aaatgaaggctttaaagtca

SEQ ID NO: 32042 - DNA, 20 bp, Artificial Sequence
  Description of Artificial Sequence: Synthetic oligonucleotide
  Target: ATXN1; (-) strand; PAM type: NNNNGHTT; PAM sequence: GAAGGCTT
cagagagggagggtgaaaat

SEQ ID NO: 32043 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
agggtttgttgttttaattt

SEQ ID NO: 32044 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
aggtgacatttgagagggtt

SEQ ID NO: 32045 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
atagaaaaggtgacatttga

SEQ ID NO: 32046 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
cttgattcattgcaattatt

SEQ ID NO: 32047 - DNA, 20 bp, Artificial Sequence
  Description of Artificial Sequence: Synthetic oligonucleotide
  Target: ATXN1; (-) strand; PAM type: NNNNGHTT; PAM sequence: TCTTGATT
aagcagttcatacagatgcc

SEQ ID NO: 32048 - DNA, 20 bp, Artificial Sequence
  Description of Artificial Sequence: Synthetic oligonucleotide
  Target: ATXN1; (-) strand; PAM type: NNNNGHTT; PAM sequence: GCAGGTTT
atttggttttacctgcaggt

SEQ ID NO: 32049 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
tagaaatcgttttgatgtca

SEQ ID NO: 32050 - DNA, 20 bp, Artificial Sequence
  Description of Artificial Sequence: Synthetic oligonucleotide
  Target: ATXN1; (-) strand; PAM type: NNNNGHTT; PAM sequence: AATCGTTT
gcttttaatttgcaagtaga

SEQ ID NO: 32051 - DNA, 20 bp, Artificial Sequence
  Description of Artificial Sequence: Synthetic oligonucleotide
  Target: ATXN1; (-) strand; PAM type: NNNNGHTT; PAM sequence: TTCTGCTT
cagtaatatcaagggccata

SEQ ID NO: 32052 - DNA, 20 bp, Artificial Sequence
  Description of Artificial Sequence: Synthetic oligonucleotide
  Target: ATXN1; (-) strand; PAM type: NNNNGHTT; PAM sequence: CTCTGCTT
ttgcaagaggagtgcagaag

SEQ ID NO: 32053 - DNA, 20 bp, Artificial Sequence
  Description of Artificial Sequence: Synthetic oligonucleotide
  Target: ATXN1; (-) strand; PAM type: NNNNGHTT; PAM sequence: GTGGGATT
aaagaatctttcagctgatt

SEQ ID NO: 32054 - DNA, 20 bp, Artificial Sequence
  Description of Artificial Sequence: Synthetic oligonucleotide
  Target: ATXN1; (-) strand; PAM type: NNNNGHTT; PAM sequence: AGCTGATT
ataactggaaagaatctttc

SEQ ID NO: 32055 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
tcatttatcaccccatctat

SEQ ID NO: 32056 - DNA, 20 bp, Artificial Sequence
  Description of Artificial Sequence: Synthetic oligonucleotide
  Target: ATXN1; (-) strand; PAM type: NNNNGHTT; PAM sequence: GTTAGATT
atttgctgttgtttgacttt

SEQ ID NO: 32057 - DNA, 20 bp, Artificial Sequence
  Description of Artificial Sequence: Synthetic oligonucleotide
  Target: ATXN1; (-) strand; PAM type: NNNNGHTT; PAM sequence: TGTTGTTT
ttctgtcaaacatcatttgc

SEQ ID NO: 32058 - DNA, 20 bp, Artificial Sequence
  Description of Artificial Sequence: Synthetic oligonucleotide
  Target: ATXN1; (-) strand; PAM type: NNNNGHTT; PAM sequence: CTTTGCTT
gctcccggctcccccaagac

SEQ ID NO: 32059 - DNA, 20 bp, Artificial Sequence
  Description of Artificial Sequence: Synthetic oligonucleotide
  Target: ATXN1; (-) strand; PAM type: NNNNGHTT; PAM sequence: AATAGATT
tgacattgtacagttccatg

SEQ ID NO: 32060 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
ctcactgtaccttgctgggt

SEQ ID NO: 32061 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
ttggactggtagtttggagg

SEQ ID NO: 32062 - DNA, 20 bp, Artificial Sequence
  Description of Artificial Sequence: Synthetic oligonucleotide
  Target: ATXN1; (-) strand; PAM type: NNNNGHTT; PAM sequence: GGTAGTTT
gtatggtgtgctgttggact

SEQ ID NO: 32063 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
gtttaatgatcttttgaaaa

SEQ ID NO: 32064 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
aaaggaatttaatatgtata

SEQ ID NO: 32065 - DNA, 20 bp, Artificial Sequence
  Description of Artificial Sequence: Synthetic oligonucleotide
  Target: ATXN1; (-) strand; PAM type: NNNNGHTT; PAM sequence: CCAGGCTT
ttttccaaaagaaatcaaaa

SEQ ID NO: 32066 - DNA, 20 bp, Artificial Sequence
  Description of Artificial Sequence: Synthetic oligonucleotide
  Target: ATXN1; (-) strand; PAM type: NNNNGHTT; PAM sequence: TGCAGTTT
agattaaacaccgagcagcg

SEQ ID NO: 32067 - DNA, 20 bp, Artificial Sequence
  Description of Artificial Sequence: Synthetic oligonucleotide
  Target: ATXN1; (-) strand; PAM type: NNNNGHTT; PAM sequence: ACCAGATT
ctgttaatatttcactcaat

SEQ ID NO: 32068 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
gatatgtttttcgagttctg

SEQ ID NO: 32069 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
tgggggatatgtttttcgag

SEQ ID NO: 32070 - DNA, 20 bp, Artificial Sequence
  Description of Artificial Sequence: Synthetic oligonucleotide
  Target: ATXN1; (-) strand; PAM type: NNNNGHTT; PAM sequence: ATATGTTT
ctccactgtaggcctggggg

SEQ ID NO: 32071 - DNA, 20 bp, Artificial Sequence
  Description of Artificial Sequence: Synthetic oligonucleotide
  Target: ATXN1; (-) strand; PAM type: NNNNGHTT; PAM sequence: TGGAGTTT
tgggcttgttgagcagagcg

SEQ ID NO: 32072 - DNA, 20 bp, Artificial Sequence
  Description of Artificial Sequence: Synthetic oligonucleotide
  Target: ATXN1; (-) strand; PAM type: NNNNGHTT; PAM sequence: ATGGGCTT
tgatgagttacttaacagcg

SEQ ID NO: 32073 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
gtcgtctgcttcagagaact

SEQ ID NO: 32074 - DNA, 20 bp, Artificial Sequence
  Description of Artificial Sequence: Synthetic oligonucleotide
  Target: ATXN1; (-) strand; PAM type: NNNNGHTT; PAM sequence: GTCTGCTT
ccctgtaacagttgtatgtc

SEQ ID NO: 32075 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
atatgtgatgcatttttatt

SEQ ID NO: 32076 - DNA, 20 bp, Artificial Sequence
  Description of Artificial Sequence: Synthetic oligonucleotide
  Target: ATXN1; (-) strand; PAM type: NNNNGHTT; PAM sequence: GGCAGCTT
tactattcgtgccctagcct

SEQ ID NO: 32077 - DNA, 20 bp, Artificial Sequence
  Description of Artificial Sequence: Synthetic oligonucleotide
  Target: ATXN1; (-) strand; PAM type: NNNNGHTT; PAM sequence: GCAAGATT
acggaaatcgagaagaggat

SEQ ID NO: 32078 - DNA, 20 bp, Artificial Sequence
  Description of Artificial Sequence: Synthetic oligonucleotide
  Target: ATXN1; (-) strand; PAM type: NNNNGHTT; PAM sequence: TCTTGCTT
ttggtcttcaaggcaacatc

SEQ ID NO: 32079 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
agtgaaaaattactgaggac

SEQ ID NO: 32080 - DNA, 20 bp, Artificial Sequence
  Description of Artificial Sequence: Synthetic oligonucleotide
  Target: ATXN1; (-) strand; PAM type: NNNNGHTT; PAM sequence: GCCAGATT
tcttagctggcttagggaag

SEQ ID NO: 32081 - DNA, 20 bp, Artificial Sequence
  Description of Artificial Sequence: Synthetic oligonucleotide
  Target: ATXN1; (-) strand; PAM type: NNNNGHTT; PAM sequence: GCTGGCTT
agaaagatcactttctctta

SEQ ID NO: 32082 - DNA, 20 bp, Artificial Sequence
  Description of Artificial Sequence: Synthetic oligonucleotide
  Target: ATXN1; (-) strand; PAM type: NNNNGHTT; PAM sequence: GGAAGCTT
tttagtcagggtggccataa

SEQ ID NO: 32083 - DNA, 20 bp, Artificial Sequence
  Description of Artificial Sequence: Synthetic oligonucleotide
  Target: ATXN1; (-) strand; PAM type: NNNNGHTT; PAM sequence: TCACGCTT
aaacgtgcagcaaaaggagg

SEQ ID NO: 32084 - DNA, 20 bp, Artificial Sequence
  Description of Artificial Sequence: Synthetic oligonucleotide
  Target: ATXN1; (-) strand; PAM type: NNNNGHTT; PAM sequence: GCAAGATT
actgggtcattgctcagctt

SEQ ID NO: 32085 - DNA, 20 bp, Artificial Sequence
  Description of Artificial Sequence: Synthetic oligonucleotide
  Target: ATXN1; (-) strand; PAM type: NNNNGHTT; PAM sequence: CTCAGCTT
agaacttcactgggtcattg

SEQ ID NO: 32086 - DNA, 20 bp, Artificial Sequence
  Description of Artificial Sequence: Synthetic oligonucleotide
  Target: ATXN1; (-) strand; PAM type: NNNNGHTT; PAM sequence: ATTGGCTT
ttgcttatccgtttcagggg

SEQ ID NO: 32087 - DNA, 20 bp, Artificial Sequence
  Description of Artificial Sequence: Synthetic oligonucleotide
  Target: ATXN1; (-) strand; PAM type: NNNNGHTT; PAM sequence: AGGGGATT
gcaatttgcttatccgtttc

SEQ ID NO: 32088 - DNA, 20 bp, Artificial Sequence
  Description of Artificial Sequence: Synthetic oligonucleotide
  Target: ATXN1; (-) strand; PAM type: NNNNGHTT; PAM sequence: ATCCGTTT
atgacagtggcaatttgctt

SEQ ID NO: 32089 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
agaaaatgatgacagtggca

SEQ ID NO: 32090 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
tcactcttactcatatctcc

SEQ ID NO: 32091 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
gctgtcccatgcaggctttg

SEQ ID NO: 32092 - DNA, 20 bp, Artificial Sequence
  Description of Artificial Sequence: Synthetic oligonucleotide
  Target: ATXN1; (-) strand; PAM type: NNNNGHTT; PAM sequence: GCAGGCTT
tctgacacaggctgtcccat

SEQ ID NO: 32093 - DNA, 20 bp, Artificial Sequence
  Description of Artificial Sequence: Synthetic oligonucleotide
  Target: ATXN1; (-) strand; PAM type: NNNNGHTT; PAM sequence: ATGAGCTT
gcctgtctgttcagtcacat

SEQ ID NO: 32094 - DNA, 20 bp, Artificial Sequence
  Description of Artificial Sequence: Synthetic oligonucleotide
  Target: ATXN1; (-) strand; PAM type: NNNNGHTT; PAM sequence: CATGGCTT
gtcgagtgcataaggcaagg

SEQ ID NO: 32095 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
ttccttaagccctgtcctta

SEQ ID NO: 32096 - DNA, 20 bp, Artificial Sequence
  Description of Artificial Sequence: Synthetic oligonucleotide
  Target: ATXN1; (-) strand; PAM type: NNNNGHTT; PAM sequence: TCGTGCTT
ccagctgttaagtgatagaa

SEQ ID NO: 32097 - DNA, 20 bp, Artificial Sequence
  Description of Artificial Sequence: Synthetic oligonucleotide
  Target: ATXN1; (-) strand; PAM type: NNNNGHTT; PAM sequence: CAAGGTTT
gagagggtgaataatttccc

SEQ ID NO: 32098 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
agaaaatttgaggattaagt

SEQ ID NO: 32099 - DNA, 20 bp, Artificial Sequence
  Description of Artificial Sequence: Synthetic oligonucleotide
  Target: ATXN1; (-) strand; PAM type: NNNNGHTT; PAM sequence: TGAGGATT
taatgtaatgagagaaaatt

SEQ ID NO: 32100 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
tacgatgatgttagtgagca

SEQ ID NO: 32101 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
agacacagctctttgaacaa

SEQ ID NO: 32102 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
ctctttaaaatgtgagatgt

SEQ ID NO: 32103 - DNA, 20 bp, Artificial Sequence
  Description of Artificial Sequence: Synthetic oligonucleotide
  Target: ATXN1; (-) strand; PAM type: NNNNGHTT; PAM sequence: GGAGGCTT
gtaactttagaggattccct

SEQ ID NO: 32104 - DNA, 20 bp, Artificial Sequence
  Description of Artificial Sequence: Synthetic oligonucleotide
  Target: ATXN1; (-) strand; PAM type: NNNNGHTT; PAM sequence: AGAGGATT
tgggtgtgttttgtaacttt

SEQ ID NO: 32105 - DNA, 20 bp, Artificial Sequence
  Description of Artificial Sequence: Synthetic oligonucleotide
  Target: ATXN1; (-) strand; PAM type: NNNNGHTT; PAM sequence: GTGTGTTT
gataaaccacattaatttgg

SEQ ID NO: 32106 - DNA, 20 bp, Artificial Sequence
  Description of Artificial Sequence: Synthetic oligonucleotide
  Target: ATXN1; (-) strand; PAM type: NNNNGHTT; PAM sequence: CGTTGATT
atttctttgatcttttctac

SEQ ID NO: 32107 - DNA, 20 bp, Artificial Sequence
  Description of Artificial Sequence: Synthetic oligonucleotide
  Target: ATXN1; (-) strand; PAM type: NNNNGHTT; PAM sequence: GTACGTTT
aagattttcagtgaagccct

SEQ ID NO: 32108 - DNA, 20 bp, Artificial Sequence
  Description of Artificial Sequence: Synthetic oligonucleotide
  Target: ATXN1; (-) strand; PAM type: NNNNGHTT; PAM sequence: TTAAGATT
ttttcctctaaacagtttta

SEQ ID NO: 32109 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
gatccttctattttcctcta

SEQ ID NO: 32110 - DNA, 20 bp, Artificial Sequence
  Description of Artificial Sequence: Synthetic oligonucleotide
  Target: ATXN1; (-) strand; PAM type: NNNNGHTT; PAM sequence: CTGCGTTT
tgtgtgtataaaaatgaatg

SEQ ID NO: 32111 - DNA, 20 bp, Artificial Sequence
  Description of Artificial Sequence: Synthetic oligonucleotide
  Target: ATXN1; (-) strand; PAM type: NNNNGHTT; PAM sequence: AGTAGCTT
gaaggtaagaggcagcggag

SEQ ID NO: 32112 - DNA, 20 bp, Artificial Sequence
  Description of Artificial Sequence: Synthetic oligonucleotide
  Target: ATXN1; (-) strand; PAM type: NNNNGHTT; PAM sequence: AAAAGTTT
ttgggttcttgggcctggca

SEQ ID NO: 32113 - DNA, 20 bp, Artificial Sequence
  Description of Artificial Sequence: Synthetic oligonucleotide
  Target: ATXN1; (-) strand; PAM type: NNNNGHTT; PAM sequence: TCTGGATT
tgctggtggacatctgaatt

SEQ ID NO: 32114 - DNA, 20 bp, Artificial Sequence
  Description of Artificial Sequence: Synthetic oligonucleotide
  Target: ATXN1; (-) strand; PAM type: NNNNGHTT; PAM sequence: ACTAGATT
acttgagttgagctctgctg

SEQ ID NO: 32115 - DNA, 20 bp, Artificial Sequence
  Description of Artificial Sequence: Synthetic oligonucleotide
  Target: ATXN1; (-) strand; PAM type: NNNNGHTT; PAM sequence: AAATGATT
cagtcactatttatgtaaag

SEQ ID NO: 32116 - DNA, 20 bp, Artificial Sequence
  Description of Artificial Sequence: Synthetic oligonucleotide
  Target: ATXN1; (-) strand; PAM type: NNNNGHTT; PAM sequence: TTCAGTTT
gttgtactcttttatattca

SEQ ID NO: 32117 - DNA, 20 bp, Artificial Sequence
  Description of Artificial Sequence: Synthetic oligonucleotide
  Target: ATXN1; (-) strand; PAM type: NNNNGHTT; PAM sequence: TCACGATT
taatggcctcattacagtcc

SEQ ID NO: 32118 - DNA, 20 bp, Artificial Sequence
  Description of Artificial Sequence: Synthetic oligonucleotide
  Target: ATXN1; (-) strand; PAM type: NNNNGHTT; PAM sequence: GAAAGCTT
tttctatgattgcatttaaa

SEQ ID NO: 32119 - DNA, 20 bp, Artificial Sequence
  Description of Artificial Sequence: Synthetic oligonucleotide
  Target: ATXN1; (-) strand; PAM type: NNNNGHTT; PAM sequence: CTATGATT
attttaagcgctgacatttt

SEQ ID NO: 32120 - DNA, 20 bp, Artificial Sequence
  Description of Artificial Sequence: Synthetic oligonucleotide
  Target: ATXN1; (-) strand; PAM type: NNNNGHTT; PAM sequence: GCAAGTTT
aggtttttataatatgttag

SEQ ID NO: 32121 - DNA, 20 bp, Artificial Sequence
  Description of Artificial Sequence: Synthetic oligonucleotide
  Target: ATXN1; (-) strand; PAM type: NNNNGHTT; PAM sequence: CTAGGTTT
gcagcttattgagaagagac

SEQ ID NO: 32122 - DNA, 20 bp, Artificial Sequence
  Description of Artificial Sequence: Synthetic oligonucleotide
  Target: ATXN1; (-) strand; PAM type: NNNNGHTT; PAM sequence: GGCAGCTT
catatctcttggtcaatatg

SEQ ID NO: 32123 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
cacatttagatctttgggga

SEQ ID NO: 32124 - DNA, 20 bp, Artificial Sequence
  Description of Artificial Sequence: Synthetic oligonucleotide
  Target: ATXN1; (-) strand; PAM type: NNNNGHTT; PAM sequence: AATCGCTT
ttgggacactgaggcaggag

SEQ ID NO: 32125 - DNA, 20 bp, Artificial Sequence
  Description of Artificial Sequence: Synthetic oligonucleotide
  Target: ATXN1; (-) strand; PAM type: NNNNGHTT; PAM sequence: AGGAGTTT
tgggtgaatcacttgaggtc

SEQ ID NO: 32126 - DNA, 20 bp, Artificial Sequence
  Description of Artificial Sequence: Synthetic oligonucleotide
  Target: ATXN1; (-) strand; PAM type: NNNNGHTT; PAM sequence: TGTGGATT
attccttacattttattggc

SEQ ID NO: 32127 - DNA, 20 bp, Artificial Sequence
  Description of Artificial Sequence: Synthetic oligonucleotide
  Target: ATXN1; (-) strand; PAM type: NNNNGHTT; PAM sequence: ACTGGATT
atactcttgtaaaatatgga

SEQ ID NO: 32128 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
gcatgtgtggtttttttttt

SEQ ID NO: 32129 - DNA, 20 bp, Artificial Sequence
  Description of Artificial Sequence: Synthetic oligonucleotide
  Target: ATXN1; (-) strand; PAM type: NNNNGHTT; PAM sequence: TGTGGTTT
tctgactgatgggatgcatg

SEQ ID NO: 32130 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
gcaaagccaaggagcctttt

SEQ ID NO: 32131 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
caacaggttgattgttatgg

SEQ ID NO: 32132 - DNA, 20 bp, Artificial Sequence
  Description of Artificial Sequence: Synthetic oligonucleotide
  Target: ATXN1; (-) strand; PAM type: NNNNGHTT; PAM sequence: GGTTGATT
aagtaacttatccctcaaca

SEQ ID NO: 32133 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
gggtagaatagtacctggtg

SEQ ID NO: 32134 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
gtcctatgtcctttcaatgc

SEQ ID NO: 32135 - DNA, 20 bp, Artificial Sequence
  Description of Artificial Sequence: Synthetic oligonucleotide
  Target: ATXN1; (-) strand; PAM type: NNNNGHTT; PAM sequence: ACCAGATT
gttcatttaaacaataattg

SEQ ID NO: 32136 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
ttttcaagaggtagatggat

SEQ ID NO: 32137 - DNA, 20 bp, Artificial Sequence
  Description of Artificial Sequence: Synthetic oligonucleotide
  Target: ATXN1; (-) strand; PAM type: NNNNGHTT; PAM sequence: ACAGGTTT
tgtctaggcactgatgctcc

SEQ ID NO: 32138 - DNA, 20 bp, Artificial Sequence
  Description of Artificial Sequence: Synthetic oligonucleotide
  Target: ATXN1; (-) strand; PAM type: NNNNGHTT; PAM sequence: GAATGTTT
accctagacttgatgaatca

SEQ ID NO: 32139 - DNA, 20 bp, Artificial Sequence
  Description of Artificial Sequence: Synthetic oligonucleotide
  Target: ATXN1; (-) strand; PAM type: NNNNGHTT; PAM sequence: GAGAGCTT
ctaggcaacagaatcacctg

SEQ ID NO: 32140 - DNA, 20 bp, Artificial Sequence
  Description of Artificial Sequence: Synthetic oligonucleotide
  Target: ATXN1; (-) strand; PAM type: NNNNGHTT; PAM sequence: ACTAGATT
gcttgaaactgtgaagacag

SEQ ID NO: 32141 - DNA, 20 bp, Artificial Sequence
  Description of Artificial Sequence: Synthetic oligonucleotide
  Target: ATXN1; (-) strand; PAM type: NNNNGHTT; PAM sequence: ACCTGCTT
tctatttgccttggaaatgg

SEQ ID NO: 32142 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
gtttgagtgtatgtaaccaa

SEQ ID NO: 32143 - DNA, 20 bp, Artificial Sequence
  Description of Artificial Sequence: Synthetic oligonucleotide
  Target: ATXN1; (-) strand; PAM type: NNNNGHTT; PAM sequence: AAGGGTTT
cagtaagggcttgggaacac

SEQ ID NO: 32144 - DNA, 20 bp, Artificial Sequence
  Description of Artificial Sequence: Synthetic oligonucleotide
  Target: ATXN1; (-) strand; PAM type: NNNNGHTT; PAM sequence: AAGGGCTT
ttgctagaacttggggcagt

SEQ ID NO: 32145 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
aattaaatcaggaaggaaaa

SEQ ID NO: 32146 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
tcctgattttcccacgtaca

SEQ ID NO: 32147 - DNA, 20 bp, Artificial Sequence
  Description of Artificial Sequence: Synthetic oligonucleotide
  Target: ATXN1; (-) strand; PAM type: NNNNGHTT; PAM sequence: TCCTGATT
tctgtttggattttacaact

SEQ ID NO: 32148 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
cttgaatttctttgtgtctg

SEQ ID NO: 32149 - DNA, 20 bp, Artificial Sequence
  Description of Artificial Sequence: Synthetic oligonucleotide
  Target: ATXN1; (-) strand; PAM type: NNNNGHTT; PAM sequence: GTCTGTTT
tgaatcttgaatttctttgt

SEQ ID NO: 32150 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
gcgtagcaaaacagagacct

SEQ ID NO: 32151 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
ttaagtcacagtttttgcat

SEQ ID NO: 32152 - DNA, 20 bp, Artificial Sequence
  Description of Artificial Sequence: Synthetic oligonucleotide
  Target: ATXN1; (-) strand; PAM type: NNNNGHTT; PAM sequence: CACAGTTT
tgctaccagatatcttaagt

SEQ ID NO: 32153 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
tgaacctcatcattttaatt

SEQ ID NO: 32154 - DNA, 20 bp, Artificial Sequence
  Description of Artificial Sequence: Synthetic oligonucleotide
  Target: ATXN1; (-) strand; PAM type: NNNNGHTT; PAM sequence: TGGGGCTT
gatgattgataattgccaat

SEQ ID NO: 32155 - DNA, 20 bp, Artificial Sequence
  Description of Artificial Sequence: Synthetic oligonucleotide
  Target: ATXN1; (-) strand; PAM type: NNNNGHTT; PAM sequence: CGATGATT
aagactttcatttgactttg

SEQ ID NO: 32156 - DNA, 20 bp, Artificial Sequence
  Description of Artificial Sequence: Synthetic oligonucleotide
  Target: ATXN1; (-) strand; PAM type: NNNNGHTT; PAM sequence: TTTGGTTT
tcgattaaagtatctatcta

SEQ ID NO: 32157 - DNA, 20 bp, Artificial Sequence
  Description of Artificial Sequence: Synthetic oligonucleotide
  Target: ATXN1; (-) strand; PAM type: NNNNGHTT; PAM sequence: CTTCGATT
gccaagattgttttttaaaa

SEQ ID NO: 32158 - DNA, 20 bp, Artificial Sequence
  Description of Artificial Sequence: Synthetic oligonucleotide
  Target: ATXN1; (-) strand; PAM type: NNNNGHTT; PAM sequence: GATTGTTT
ggaagttgagaaattgccaa

SEQ ID NO: 32159 - DNA, 20 bp, Artificial Sequence
  Description of Artificial Sequence: Synthetic oligonucleotide
  Target: ATXN1; (-) strand; PAM type: NNNNGHTT; PAM sequence: CCAAGATT
tgtgggaagttgagaaattg

SEQ ID NO: 32160 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
aatatcattttctttgcaaa

SEQ ID NO: 32161 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
ggtgagagttttgcgatgct

SEQ ID NO: 32162 - DNA, 20 bp, Artificial Sequence
  Description of Artificial Sequence: Synthetic oligonucleotide
  Target: ATXN1; (-) strand; PAM type: NNNNGHTT; PAM sequence: GAGAGTTT
aagtgcatcacatgtcaggt

SEQ ID NO: 32163 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
gtggtccattcaagctgcag

SEQ ID NO: 32164 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
ccagggtggtccattcaagc

SEQ ID NO: 32165 - DNA, 20 bp, Artificial Sequence
  Description of Artificial Sequence: Synthetic oligonucleotide
  Target: ATXN1; (-) strand; PAM type: NNNNGHTT; PAM sequence: TTTGGATT
cagtctattctgtttttcat

SEQ ID NO: 32166 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
ttattttttaaagcagtcta

SEQ ID NO: 32167 - DNA, 20 bp, Artificial Sequence
  Description of Artificial Sequence: Synthetic oligonucleotide
  Target: ATXN1; (-) strand; PAM type: NNNNGHTT; PAM sequence: AGATGATT
gttaccagcatgtgtttatc

SEQ ID NO: 32168 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
tactccttgtagttaccagc

SEQ ID NO: 32169 - DNA, 20 bp, Artificial Sequence
  Description of Artificial Sequence: Synthetic oligonucleotide
  Target: ATXN1; (-) strand; PAM type: NNNNGHTT; PAM sequence: TTAGGCTT
taatatatgccacattaaaa

SEQ ID NO: 32170 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
atagctgtgcactttcatca

SEQ ID NO: 32171 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
tatttaaataaagtttagtg

SEQ ID NO: 32172 - DNA, 20 bp, Artificial Sequence
  Description of Artificial Sequence: Synthetic oligonucleotide
  Target: ATXN1; (-) strand; PAM type: NNNNGHTT; PAM sequence: TAAAGTTT
atgtacattcagtatttaaa

SEQ ID NO: 32173 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
tccctgatggaaaggtatat

SEQ ID NO: 32174 - DNA, 20 bp, Artificial Sequence
  Description of Artificial Sequence: Synthetic oligonucleotide
  Target: ATXN1; (-) strand; PAM type: NNNNGHTT; PAM sequence: ATAGGTTT
aacttcttccgtttctatgc

SEQ ID NO: 32175 - DNA, 20 bp, Artificial Sequence
  Description of Artificial Sequence: Synthetic oligonucleotide
  Target: ATXN1; (-) strand; PAM type: NNNNGHTT; PAM sequence: TTCCGTTT
cagatcgagtcctcaacttc

SEQ ID NO: 32176 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
gattttaaaaaaattttttt

SEQ ID NO: 32177 - DNA, 20 bp, Artificial Sequence
  Description of Artificial Sequence: Synthetic oligonucleotide
  Target: ATXN1; (-) strand; PAM type: NNNNGHTT; PAM sequence: TACTGATT
tgattttatagtaaccctgc

SEQ ID NO: 32178 - DNA, 20 bp, Artificial Sequence
  Description of Artificial Sequence: Synthetic oligonucleotide
  Target: ATXN1; (-) strand; PAM type: NNNNGHTT; PAM sequence: GGATGATT
tccagcattcactagtttgg

SEQ ID NO: 32179 - DNA, 20 bp, Artificial Sequence
  Description of Artificial Sequence: Synthetic oligonucleotide
  Target: ATXN1; (-) strand; PAM type: NNNNGHTT; PAM sequence: ACTAGTTT
tgaaaatcagtccagcattc

SEQ ID NO: 32180 - DNA, 20 bp, Artificial Sequence
  Description of Artificial Sequence: Synthetic oligonucleotide
  Target: ATXN1; (-) strand; PAM type: NNNNGHTT; PAM sequence: CTAAGTTT
gtgagcttaggaaacccaaa

SEQ ID NO: 32181 - DNA, 20 bp, Artificial Sequence
  Description of Artificial Sequence: Synthetic oligonucleotide
  Target: ATXN1; (-) strand; PAM type: NNNNGHTT; PAM sequence: GTGAGCTT
tcttcctactgttacctggc

SEQ ID NO: 32182 - DNA, 20 bp, Artificial Sequence
  Description of Artificial Sequence: Synthetic oligonucleotide
  Target: ATXN1; (-) strand; PAM type: NNNNGHTT; PAM sequence: AATAGTTT
gatcatattcatagctccag

SEQ ID NO: 32183 - DNA, 20 bp, Artificial Sequence
  Description of Artificial Sequence: Synthetic oligonucleotide
  Target: ATXN1; (-) strand; PAM type: NNNNGHTT; PAM sequence: TACGGATT
aattggctcacttacctgtt

SEQ ID NO: 32184 - DNA, 20 bp, Artificial Sequence
  Description of Artificial Sequence: Synthetic oligonucleotide
  Target: ATXN1; (-) strand; PAM type: NNNNGHTT; PAM sequence: ACCTGTTT
caaggataattggctcactt

SEQ ID NO: 32185 - DNA, 20 bp, Artificial Sequence
  Description of Artificial Sequence: Synthetic oligonucleotide
  Target: ATXN1; (-) strand; PAM type: NNNNGHTT; PAM sequence: AATGGATT
gcttaaataaatgcttggtg

SEQ ID NO: 32186 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
caggcaatcaatgcttaaat

SEQ ID NO: 32187 - DNA, 20 bp, Artificial Sequence
  Description of Artificial Sequence: Synthetic oligonucleotide
  Target: ATXN1; (-) strand; PAM type: NNNNGHTT; PAM sequence: CAATGCTT
atcagtcctcggcaggcaat

SEQ ID NO: 32188 - DNA, 20 bp, Artificial Sequence
  Description of Artificial Sequence: Synthetic oligonucleotide
  Target: ATXN1; (-) strand; PAM type: NNNNGHTT; PAM sequence: AACAGCTT
tgaaagaccttatagtgtat

SEQ ID NO: 32189 - DNA, 20 bp, Artificial Sequence
  Description of Artificial Sequence: Synthetic oligonucleotide
  Target: ATXN1; (-) strand; PAM type: NNNNGHTT; PAM sequence: ACAGGCTT
ttatttatatttgtaactca

SEQ ID NO: 32190 - DNA, 20 bp, Artificial Sequence
  Description of Artificial Sequence: Synthetic oligonucleotide
  Target: ATXN1; (-) strand; PAM type: NNNNGHTT; PAM sequence: CTAAGATT
tcctcatccttaaagaagta

SEQ ID NO: 32191 - DNA, 20 bp, Artificial Sequence
  Description of Artificial Sequence: Synthetic oligonucleotide
  Target: ATXN1; (-) strand; PAM type: NNNNGHTT; PAM sequence: CCCTGCTT
atgacatcatgatcctccct

SEQ ID NO: 32192 - DNA, 20 bp, Artificial Sequence
  Description of Artificial Sequence: Synthetic oligonucleotide
  Target: ATXN1; (-) strand; PAM type: NNNNGHTT; PAM sequence: TGATGCTT
catttgagaatcaagtattt

SEQ ID NO: 32193 - DNA, 20 bp, Artificial Sequence
  Description of Artificial Sequence: Synthetic oligonucleotide
  Target: ATXN1; (-) strand; PAM type: NNNNGHTT; PAM sequence: ACAGGATT
atctgccaggtgatatgtaa

SEQ ID NO: 32194 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
aatcttctatggcatttaca

SEQ ID NO: 32195 - DNA, 20 bp, Artificial Sequence
  Description of Artificial Sequence: Synthetic oligonucleotide
  Target: ATXN1; (-) strand; PAM type: NNNNGHTT; PAM sequence: CCTTGCTT
tttgcagtgaatacgtgctg

SEQ ID NO: 32196 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
attttctggtatattatttt

SEQ ID NO: 32197 - DNA, 20 bp, Artificial Sequence
  Description of Artificial Sequence: Synthetic oligonucleotide
  Target: ATXN1; (-) strand; PAM type: NNNNGHTT; PAM sequence: CTGGGTTT
tattgtattatgttgctctg

SEQ ID NO: 32198 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
cttactgaccattacctcag

SEQ ID NO: 32199 - DNA, 20 bp, Artificial Sequence
  Description of Artificial Sequence: Synthetic oligonucleotide
  Target: ATXN1; (-) strand; PAM type: NNNNGHTT; PAM sequence: CTCAGTTT
tggtacttactgaccattac

SEQ ID NO: 32200 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
ttttgaatgagttaggtagc

SEQ ID NO: 32201 - DNA, 20 bp, Artificial Sequence
  Description of Artificial Sequence: Synthetic oligonucleotide
  Target: ATXN1; (-) strand; PAM type: NNNNGHTT; PAM sequence: ACAAGTTT
cttaggtgccctttaacatg

SEQ ID NO: 32202 - DNA, 20 bp, Artificial Sequence
  Description of Artificial Sequence: Synthetic oligonucleotide
  Target: ATXN1; (-) strand; PAM type: NNNNGHTT; PAM sequence: TTTTGATT
aggtttccccgattgtgatg

SEQ ID NO: 32203 - DNA, 20 bp, Artificial Sequence
  Description of Artificial Sequence: Synthetic oligonucleotide
  Target: ATXN1; (-) strand; PAM type: NNNNGHTT; PAM sequence: TGATGTTT
ggcagaggtttccccgattg

SEQ ID NO: 32204 - DNA, 20 bp, Artificial Sequence
  Description of Artificial Sequence: Synthetic oligonucleotide
  Target: ATXN1; (-) strand; PAM type: NNNNGHTT; PAM sequence: CCCCGATT
actcaagagggcagaggttt

SEQ ID NO: 32205 - DNA, 20 bp, Artificial Sequence
  Description of Artificial Sequence: Synthetic oligonucleotide
  Target: ATXN1; (-) strand; PAM type: NNNNGHTT; PAM sequence: AGAGGTTT
aatttgagactcaagagggc

SEQ ID NO: 32206 - DNA, 20 bp, Artificial Sequence
  Description of Artificial Sequence: Synthetic oligonucleotide
  Target: ATXN1; (-) strand; PAM type: NNNNGHTT; PAM sequence: CATTGATT
tcatgttagcagaaatgttt

SEQ ID NO: 32207 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
gacatatttcatgttagcag

SEQ ID NO: 32208 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
aaaaagcaacaagcattata

SEQ ID NO: 32209 - DNA, 20 bp, Artificial Sequence
  Description of Artificial Sequence: Synthetic oligonucleotide
  Target: ATXN1; (-) strand; PAM type: NNNNGHTT; PAM sequence: ACACGTTT
accatcccaaatgtaccaaa

SEQ ID NO: 32210 - DNA, 20 bp, Artificial Sequence
  Description of Artificial Sequence: Synthetic oligonucleotide
  Target: ATXN1; (-) strand; PAM type: NNNNGHTT; PAM sequence: GAAAGTTT
ggttttagacaaatcttatg

SEQ ID NO: 32211 - DNA, 20 bp, Artificial Sequence
  Description of Artificial Sequence: Synthetic oligonucleotide
  Target: ATXN1; (-) strand; PAM type: NNNNGHTT; PAM sequence: AATGGTTT
attacagaagtaataaaaag

SEQ ID NO: 32212 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
tgagatttttaaaaatatat

SEQ ID NO: 32213 - DNA, 20 bp, Artificial Sequence
  Description of Artificial Sequence: Synthetic oligonucleotide
  Target: ATXN1; (-) strand; PAM type: NNNNGHTT; PAM sequence: TTGAGATT
ctgaaagaacggtaattaca

SEQ ID NO: 32214 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
tttaagaagtgatatacagt

SEQ ID NO: 32215 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
cacattttattttcatgtaa

SEQ ID NO: 32216 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
atggtaatagaaataataat

SEQ ID NO: 32217 - DNA, 20 bp, Artificial Sequence
  Description of Artificial Sequence: Synthetic oligonucleotide
  Target: ATXN1; (-) strand; PAM type: NNNNGHTT; PAM sequence: AACAGATT
gcagcttaattgcttcaaat

SEQ ID NO: 32218 - DNA, 20 bp, Artificial Sequence
  Description of Artificial Sequence: Synthetic oligonucleotide
  Target: ATXN1; (-) strand; PAM type: NNNNGHTT; PAM sequence: AATTGCTT
gatttagatctgtgcagctt

SEQ ID NO: 32219 - DNA, 20 bp, Artificial Sequence
  Description of Artificial Sequence: Synthetic oligonucleotide
  Target: ATXN1; (-) strand; PAM type: NNNNGHTT; PAM sequence: TGCAGCTT
ctgtgagagatttagatctg

SEQ ID NO: 32220 - DNA, 20 bp, Artificial Sequence
  Description of Artificial Sequence: Synthetic oligonucleotide
  Target: ATXN1; (-) strand; PAM type: NNNNGHTT; PAM sequence: GAGAGATT
ttcgaatgattagtttctgt

SEQ ID NO: 32221 - DNA, 20 bp, Artificial Sequence
  Description of Artificial Sequence: Synthetic oligonucleotide
  Target: ATXN1; (-) strand; PAM type: NNNNGHTT; PAM sequence: ATTAGTTT
gtaattcaatagttcgaatg

SEQ ID NO: 32222 - DNA, 20 bp, Artificial Sequence
  Description of Artificial Sequence: Synthetic oligonucleotide
  Target: ATXN1; (-) strand; PAM type: NNNNGHTT; PAM sequence: GAATGATT
tcagagtaattcaatagttc

SEQ ID NO: 32223 - DNA, 20 bp, Artificial Sequence
  Description of Artificial Sequence: Synthetic oligonucleotide
  Target: ATXN1; (-) strand; PAM type: NNNNGHTT; PAM sequence: GATAGATT
gctattatttttaggggaga

SEQ ID NO: 32224 - DNA, 20 bp, Artificial Sequence
  Description of Artificial Sequence: Synthetic oligonucleotide
  Target: ATXN1; (-) strand; PAM type: NNNNGHTT; PAM sequence: AACAGCTT
aacacatagattaggatctg

SEQ ID NO: 32225 - DNA, 20 bp, Artificial Sequence
  Description of Artificial Sequence: Synthetic oligonucleotide
  Target: ATXN1; (-) strand; PAM type: NNNNGHTT; PAM sequence: CATAGATT
gtagttatctgaaaataaca

SEQ ID NO: 32226 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
atgactaacactaacactca

SEQ ID NO: 32227 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
tttttgcacataccttgagt

SEQ ID NO: 32228 - DNA, 20 bp, Artificial Sequence
  Description of Artificial Sequence: Synthetic oligonucleotide
  Target: ATXN1; (-) strand; PAM type: NNNNGHTT; PAM sequence: AGTGGATT
tttttcattctgaaatgtca

SEQ ID NO: 32229 - DNA, 20 bp, Artificial Sequence
  Description of Artificial Sequence: Synthetic oligonucleotide
  Target: ATXN1; (-) strand; PAM type: NNNNGHTT; PAM sequence: TATTGTTT
tttgaataatgttgtgcctt

SEQ ID NO: 32230 - DNA, 20 bp, Artificial Sequence
  Description of Artificial Sequence: Synthetic oligonucleotide
  Target: ATXN1; (-) strand; PAM type: NNNNGHTT; PAM sequence: TCCTGTTT
ttagtaaacattactatgac

SEQ ID NO: 32231 - DNA, 20 bp, Artificial Sequence
  Description of Artificial Sequence: Synthetic oligonucleotide
  Target: ATXN1; (-) strand; PAM type: NNNNGHTT; PAM sequence: CTGAGATT
agtcctgggaaaggccagtg

SEQ ID NO: 32232 - DNA, 20 bp, Artificial Sequence
  Description of Artificial Sequence: Synthetic oligonucleotide
  Target: ATXN1; (-) strand; PAM type: NNNNGHTT; PAM sequence: GTAAGTTT
agattacatgtcaaatgcct

SEQ ID NO: 32233 - DNA, 20 bp, Artificial Sequence
  Description of Artificial Sequence: Synthetic oligonucleotide
  Target: ATXN1; (-) strand; PAM type: NNNNGHTT; PAM sequence: ACAAGATT
taaacagaaactctttagcc

SEQ ID NO: 32234 - DNA, 20 bp, Artificial Sequence
  Description of Artificial Sequence: Synthetic oligonucleotide
  Target: ATXN1; (-) strand; PAM type: NNNNGHTT; PAM sequence: GGAAGATT
aattgtcttttacacttaga

SEQ ID NO: 32235 - DNA, 20 bp, Artificial Sequence
  Description of Artificial Sequence: Synthetic oligonucleotide
  Target: ATXN1; (-) strand; PAM type: NNNNGHTT; PAM sequence: GAGGGTTT
ccttgcggatttcgttttaa

SEQ ID NO: 32236 - DNA, 20 bp, Artificial Sequence
  Description of Artificial Sequence: Synthetic oligonucleotide
  Target: ATXN1; (-) strand; PAM type: NNNNGHTT; PAM sequence: TTTCGTTT
gcaatatttttccttgcgga

SEQ ID NO: 32237 - DNA, 20 bp, Artificial Sequence
  Description of Artificial Sequence: Synthetic oligonucleotide
  Target: ATXN1; (-) strand; PAM type: NNNNGHTT; PAM sequence: TGCGGATT
ccaaaggcaatatttttcct

SEQ ID NO: 32238 - DNA, 20 bp, Artificial Sequence
  Description of Artificial Sequence: Synthetic oligonucleotide
  Target: ATXN1; (-) strand; PAM type: NNNNGHTT; PAM sequence: AAATGCTT
ctattttgcaacatatagaa

SEQ ID NO: 32239 - DNA, 20 bp, Artificial Sequence
  Description of Artificial Sequence: Synthetic oligonucleotide
  Target: ATXN1; (-) strand; PAM type: NNNNGHTT; PAM sequence: CCTGGATT
ttacacaatgccttggaggt

SEQ ID NO: 32240 - DNA, 20 bp, Artificial Sequence
  Description of Artificial Sequence: Synthetic oligonucleotide
  Target: ATXN1; (-) strand; PAM type: NNNNGHTT; PAM sequence: GTGAGTTT
ttatgagtttttaccgtttt

SEQ ID NO: 32241 - DNA, 20 bp, Artificial Sequence
  Description of Artificial Sequence: Synthetic oligonucleotide
  Target: ATXN1; (-) strand; PAM type: NNNNGHTT; PAM sequence: TACCGTTT
ccagggggtttatgagtttt

SEQ ID NO: 32242 - DNA, 20 bp, Artificial Sequence
  Description of Artificial Sequence: Synthetic oligonucleotide
  Target: ATXN1; (-) strand; PAM type: NNNNGHTT; PAM sequence: ATGAGTTT
actctattcccagggggttt

SEQ ID NO: 32243 - DNA, 20 bp, Artificial Sequence
  Description of Artificial Sequence: Synthetic oligonucleotide
  Target: ATXN1; (-) strand; PAM type: NNNNGHTT; PAM sequence: GGGGGTTT
gctactcaactctattccca

SEQ ID NO: 32244 - DNA, 20 bp, Artificial Sequence
  Description of Artificial Sequence: Synthetic oligonucleotide
  Target: ATXN1; (-) strand; PAM type: NNNNGHTT; PAM sequence: CTAGGATT
gtaaattttttcccccaggg

SEQ ID NO: 32245 - DNA, 20 bp, Artificial Sequence
  Description of Artificial Sequence: Synthetic oligonucleotide
  Target: ATXN1; (-) strand; PAM type: NNNNGHTT; PAM sequence: GTCAGTTT
tgatttagttgtgactgcca

SEQ ID NO: 32246 - DNA, 20 bp, Artificial Sequence
  Description of Artificial Sequence: Synthetic oligonucleotide
  Target: ATXN1; (-) strand; PAM type: NNNNGHTT; PAM sequence: TCTTGATT
aaagataattgagaattatg

SEQ ID NO: 32247 - DNA, 20 bp, Artificial Sequence
  Description of Artificial Sequence: Synthetic oligonucleotide
  Target: ATXN1; (-) strand; PAM type: NNNNGHTT; PAM sequence: AGTTGCTT
gcaaaaaggaaaaaaggaaa

SEQ ID NO: 32248 - DNA, 20 bp, Artificial Sequence
  Description of Artificial Sequence: Synthetic oligonucleotide
  Target: ATXN1; (-) strand; PAM type: NNNNGHTT; PAM sequence: TGGTGCTT
gctagaggactgatagtgca

SEQ ID NO: 32249 - DNA, 20 bp, Artificial Sequence
  Description of Artificial Sequence: Synthetic oligonucleotide
  Target: ATXN1; (-) strand; PAM type: NNNNGHTT; PAM sequence: AAAGGATT
tgatctttggtagtaagtta

SEQ ID NO: 32250 - DNA, 20 bp, Artificial Sequence
  Description of Artificial Sequence: Synthetic oligonucleotide
  Target: ATXN1; (-) strand; PAM type: NNNNGHTT; PAM sequence: CTGTGATT
tcttaatttggatctattgg

SEQ ID NO: 32251 - DNA, 20 bp, Artificial Sequence
  Description of Artificial Sequence: Synthetic oligonucleotide
  Target: ATXN1; (-) strand; PAM type: NNNNGHTT; PAM sequence: AAGGGTTT
tagcgatggctggatttcta

SEQ ID NO: 32252 - DNA, 20 bp, Artificial Sequence
  Description of Artificial Sequence: Synthetic oligonucleotide
  Target: ATXN1; (-) strand; PAM type: NNNNGHTT; PAM sequence: GCTGGATT
ctccattgcccatagcgatg

SEQ ID NO: 32253 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
aaggagcctgacaatcctgc

SEQ ID NO: 32254 - DNA, 20 bp, Artificial Sequence
  Description of Artificial Sequence: Synthetic oligonucleotide
  Target: ATXN1; (-) strand; PAM type: NNNNGHTT; PAM sequence: TGAGGCTT
tttggatgggagacactgaa

SEQ ID NO: 32255 - DNA, 20 bp, Artificial Sequence
  Description of Artificial Sequence: Synthetic oligonucleotide
  Target: ATXN1; (-) strand; PAM type: NNNNGHTT; PAM sequence: AAGTGTTT
tcttgtgcctgaactactcc

SEQ ID NO: 32256 - DNA, 20 bp, Artificial Sequence
  Description of Artificial Sequence: Synthetic oligonucleotide
  Target: ATXN1; (-) strand; PAM type: NNNNGHTT; PAM sequence: GTGGGTTT
agtgttcctcgtccattcag

SEQ ID NO: 32257 - DNA, 20 bp, Artificial Sequence
  Description of Artificial Sequence: Synthetic oligonucleotide
  Target: ATXN1; (-) strand; PAM type: NNNNGHTT; PAM sequence: GTAGGTTT
cctggctgcctgtcagtggt

SEQ ID NO: 32258 - DNA, 20 bp, Artificial Sequence
  Description of Artificial Sequence: Synthetic oligonucleotide
  Target: ATXN1; (-) strand; PAM type: NNNNGHTT; PAM sequence: CTCTGATT
gcgctgtggcatttaatctc

SEQ ID NO: 32259 - DNA, 20 bp, Artificial Sequence
  Description of Artificial Sequence: Synthetic oligonucleotide
  Target: ATXN1; (-) strand; PAM type: NNNNGHTT; PAM sequence: AAGGGATT
cctgcacaggaactcttgga

SEQ ID NO: 32260 - DNA, 20 bp, Artificial Sequence
  Description of Artificial Sequence: Synthetic oligonucleotide
  Target: ATXN1; (-) strand; PAM type: NNNNGHTT; PAM sequence: TGAAGCTT
tacttgagctttttttggag

SEQ ID NO: 32261 - DNA, 20 bp, Artificial Sequence
  Description of Artificial Sequence: Synthetic oligonucleotide
  Target: ATXN1; (-) strand; PAM type: NNNNGHTT; PAM sequence: TTGAGCTT
gggtaaaggtagtttgatac

SEQ ID NO: 32262 - DNA, 20 bp, Artificial Sequence
  Description of Artificial Sequence: Synthetic oligonucleotide
  Target: ATXN1; (-) strand; PAM type: NNNNGHTT; PAM sequence: GGTAGTTT
cggtttatttgatgggtaaa

SEQ ID NO: 32263 - DNA, 20 bp, Artificial Sequence
  Description of Artificial Sequence: Synthetic oligonucleotide
  Target: ATXN1; (-) strand; PAM type: NNNNGHTT; PAM sequence: TTCGGTTT
agccccccttaagcccaccc

SEQ ID NO: 32264 - DNA, 20 bp, Artificial Sequence
  Description of Artificial Sequence: Synthetic oligonucleotide
  Target: ATXN1; (-) strand; PAM type: NNNNGHTT; PAM sequence: TTGGGTTT
gttagctgagacatttctgt

SEQ ID NO: 32265 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
aacagtgttagctgagacat

SEQ ID NO: 32266 - DNA, 20 bp, Artificial Sequence
  Description of Artificial Sequence: Synthetic oligonucleotide
  Target: ATXN1; (-) strand; PAM type: NNNNGHTT; PAM sequence: GGCTGTTT
catttgtgttttataatgca

SEQ ID NO: 32267 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
tagtcacatctcaatgacat

SEQ ID NO: 32268 - DNA, 20 bp, Artificial Sequence
  Description of Artificial Sequence: Synthetic oligonucleotide
  Target: ATXN1; (-) strand; PAM type: NNNNGHTT; PAM sequence: AGTGGCTT
aataaaaactaatgccttac

SEQ ID NO: 32269 - DNA, 20 bp, Artificial Sequence
  Description of Artificial Sequence: Synthetic oligonucleotide
  Target: ATXN1; (-) strand; PAM type: NNNNGHTT; PAM sequence: CTTAGCTT
gttctgtccccgaagagatt

SEQ ID NO: 32270 - DNA, 20 bp, Artificial Sequence
  Description of Artificial Sequence: Synthetic oligonucleotide
  Target: ATXN1; (-) strand; PAM type: NNNNGHTT; PAM sequence: AAGAGATT
ccaaactggttctgtccccg

SEQ ID NO: 32271 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
agaaaggcaagctattttta

SEQ ID NO: 32272 - DNA, 20 bp, Artificial Sequence
  Description of Artificial Sequence: Synthetic oligonucleotide
  Target: ATXN1; (-) strand; PAM type: NNNNGHTT; PAM sequence: TTTTGCTT
cccgtggctgctctgttttg

SEQ ID NO: 32273 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
tcgagcccgtggctgctctg

SEQ ID NO: 32274 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
tcggttcgagcccgtggctg

SEQ ID NO: 32275 - DNA, 20 bp, Artificial Sequence
  Description of Artificial Sequence: Synthetic oligonucleotide
  Target: ATXN1; (-) strand; PAM type: NNNNGHTT; PAM sequence: CGGGGATT
aaatccgtttctaaggacgg

SEQ ID NO: 32276 - DNA, 20 bp, Artificial Sequence
  Description of Artificial Sequence: Synthetic oligonucleotide
  Target: ATXN1; (-) strand; PAM type: NNNNGHTT; PAM sequence: ATCCGTTT
acaaaacaaaacaaaaaaaa

SEQ ID NO: 32277 - DNA, 20 bp, Artificial Sequence
  Description of Artificial Sequence: Synthetic oligonucleotide
  Target: ATXN1; (-) strand; PAM type: NNNNGHTT; PAM sequence: GGGAGATT
gaaacaattcaggttttcta

SEQ ID NO: 32278 - DNA, 20 bp, Artificial Sequence
  Description of Artificial Sequence: Synthetic oligonucleotide
  Target: ATXN1; (-) strand; PAM type: NNNNGHTT; PAM sequence: TCAGGTTT
actgaaagggatgaaacaat

SEQ ID NO: 32279 - DNA, 20 bp, Artificial Sequence
  Description of Artificial Sequence: Synthetic oligonucleotide
  Target: ATXN1; (-) strand; PAM type: NNNNGHTT; PAM sequence: TTTTGTTT
ctccgtggcttgtgctttca

SEQ ID NO: 32280 - DNA, 20 bp, Artificial Sequence
  Description of Artificial Sequence: Synthetic oligonucleotide
  Target: ATXN1; (-) strand; PAM type: NNNNGHTT; PAM sequence: TTGTGCTT
gccttcttaaactccgtggc

SEQ ID NO: 32281 - DNA, 20 bp, Artificial Sequence
  Description of Artificial Sequence: Synthetic oligonucleotide
  Target: ATXN1; (-) strand; PAM type: NNNNGHTT; PAM sequence: CGTGGCTT
caggctgccttcttaaactc

SEQ ID NO: 32282 - DNA, 20 bp, Artificial Sequence
  Description of Artificial Sequence: Synthetic oligonucleotide
  Target: ATXN1; (-) strand; PAM type: NNNNGHTT; PAM sequence: CGGGGATT
ccgccgcggaggaggcgctg

SEQ ID NO: 32283 - DNA, 20 bp, Artificial Sequence
  Description of Artificial Sequence: Synthetic oligonucleotide
  Target: ATXN1; (-) strand; PAM type: NNNNGHTT; PAM sequence: GGCCGCTT
caccgccgccctgttggtgc

SEQ ID NO: 32284 - DNA, 20 bp, Artificial Sequence
  Description of Artificial Sequence: Synthetic oligonucleotide
  Target: ATXN1; (-) strand; PAM type: NNNNGHTT; PAM sequence: TTTAGATT
cccattcccttctcccctta

SEQ ID NO: 32285 - DNA, 20 bp, Artificial Sequence
  Description of Artificial Sequence: Synthetic oligonucleotide
  Target: ATXN1; (-) strand; PAM type: NNNNGHTT; PAM sequence: CTCCGATT
gtgactatttttttttcctc

SEQ ID NO: 32286 - DNA, 20 bp, Artificial Sequence
  Description of Artificial Sequence: Synthetic oligonucleotide
  Target: ATXN1; (-) strand; PAM type: NNNNGHTT; PAM sequence: CATTGTTT
gagcaacagcagccgcaaga

SEQ ID NO: 32287 - DNA, 20 bp, Artificial Sequence
  Description of Artificial Sequence: Synthetic oligonucleotide
  Target: ATXN1; (-) strand; PAM type: NNNNGHTT; PAM sequence: ACCTGTTT
cagtggcggagccgtacagg

SEQ ID NO: 32288 - DNA, 20 bp, Artificial Sequence
  Description of Artificial Sequence: Synthetic oligonucleotide
  Target: ATXN1; (-) strand; PAM type: NNNNGHTT; PAM sequence: TTTGGCTT
cggcagccaactgctccata

SEQ ID NO: 32289 - DNA, 20 bp, Artificial Sequence
  Description of Artificial Sequence: Synthetic oligonucleotide
  Target: ATXN1; (-) strand; PAM type: NNNNGHTT; PAM sequence: TCGGGATT
cgcctgggaccaaggacacg

SEQ ID NO: 32290 - DNA, 20 bp, Artificial Sequence
  Description of Artificial Sequence: Synthetic oligonucleotide
  Target: ATXN1; (-) strand; PAM type: NNNNGHTT; PAM sequence: TGTGGCTT
acgccgaagcgacgccggtt

SEQ ID NO: 32291 - DNA, 20 bp, Artificial Sequence
  Description of Artificial Sequence: Synthetic oligonucleotide
  Target: ATXN1; (-) strand; PAM type: NNNNGHTT; PAM sequence: GCCGGTTT
ttccggaacgccgaagcgac

SEQ ID NO: 32292 - DNA, 20 bp, Artificial Sequence
  Description of Artificial Sequence: Synthetic oligonucleotide
  Target: ATXN1; (-) strand; PAM type: NNNNGHTT; PAM sequence: AGCCGATT
gcggagtagttccatatcaa

SEQ ID NO: 32293 - DNA, 20 bp, Artificial Sequence
  Description of Artificial Sequence: Synthetic oligonucleotide
  Target: ATXN1; (-) strand; PAM type: NNNNGHTT; PAM sequence: TTCCGATT
tcctacactggttacctcat

SEQ ID NO: 32294 - DNA, 20 bp, Artificial Sequence
  Description of Artificial Sequence: Synthetic oligonucleotide
  Target: ATXN1; (-) strand; PAM type: NNNNGHTT; PAM sequence: GGTTGCTT
gaactgccatttgatgctcc

SEQ ID NO: 32295 - DNA, 20 bp, Artificial Sequence
  Description of Artificial Sequence: Synthetic oligonucleotide
  Target: ATXN1; (-) strand; PAM type: NNNNGHTT; PAM sequence: CGTCGATT
gagtccagatttaagttcct

SEQ ID NO: 32296 - DNA, 20 bp, Artificial Sequence
  Description of Artificial Sequence: Synthetic oligonucleotide
  Target: ATXN1; (-) strand; PAM type: NNNNGHTT; PAM sequence: TCCAGATT
gaccgcactgaaaccctgag

SEQ ID NO: 32297 - DNA, 20 bp, Artificial Sequence
  Description of Artificial Sequence: Synthetic oligonucleotide
  Target: ATXN1; (-) strand; PAM type: NNNNGHTT; PAM sequence: AGAAGATT
ggcaaggtgcacccatccga

SEQ ID NO: 32298 - DNA, 20 bp, Artificial Sequence
  Description of Artificial Sequence: Synthetic oligonucleotide
  Target: ATXN1; (-) strand; PAM type: NNNNGHTT; PAM sequence: TCATGTTT
aagaaacttacgcgaaagga

SEQ ID NO: 32299 - DNA, 20 bp, Artificial Sequence
  Description of Artificial Sequence: Synthetic oligonucleotide
  Target: ATXN1; (-) strand; PAM type: NNNNGHTT; PAM sequence: GGTGGCTT
tacagcttacagtcaagatt

SEQ ID NO: 32300 - DNA, 20 bp, Artificial Sequence
  Description of Artificial Sequence: Synthetic oligonucleotide
  Target: ATXN1; (-) strand; PAM type: NNNNGHTT; PAM sequence: TCAAGATT
ctctcaaatacagcttacag

SEQ ID NO: 32301 - DNA, 20 bp, Artificial Sequence
  Description of Artificial Sequence: Synthetic oligonucleotide
  Target: ATXN1; (-) strand; PAM type: NNNNGHTT; PAM sequence: TACAGCTT
cagccaaaagatctctcaaa

SEQ ID NO: 32302 - DNA, 20 bp, Artificial Sequence
  Description of Artificial Sequence: Synthetic oligonucleotide
  Target: ATXN1; (-) strand; PAM type: NNNNGHTT; PAM sequence: GTATGTTT
gctctgcaccttcctcgctc

SEQ ID NO: 32303 - DNA, 20 bp, Artificial Sequence
  Description of Artificial Sequence: Synthetic oligonucleotide
  Target: ATXN1; (-) strand; PAM type: NNNNGHTT; PAM sequence: AATCGATT
gaggtttaaaccgtaacaat

SEQ ID NO: 32304 - DNA, 20 bp, Artificial Sequence
  Description of Artificial Sequence: Synthetic oligonucleotide
  Target: ATXN1; (-) strand; PAM type: NNNNGHTT; PAM sequence: CGAGGTTT
aatgtcactttagaccaacc

SEQ ID NO: 32305 - DNA, 20 bp, Artificial Sequence
  Description of Artificial Sequence: Synthetic oligonucleotide
  Target: ATXN1; (-) strand; PAM type: NNNNGHTT; PAM sequence: CAAAGCTT
cgtactaaccttcaccttga

SEQ ID NO: 32306 - DNA, 20 bp, Artificial Sequence
  Description of Artificial Sequence: Synthetic oligonucleotide
  Target: ATXN1; (-) strand; PAM type: NNNNGHTT; PAM sequence: ACAAGCTT
gtcttttctatataaagcca

SEQ ID NO: 32307 - DNA, 20 bp, Artificial Sequence
  Description of Artificial Sequence: Synthetic oligonucleotide
  Target: ATXN1; (-) strand; PAM type: NNNNGHTT; PAM sequence: TTCTGTTT
tgaaatgaatagcagaagct

SEQ ID NO: 32308 - DNA, 20 bp, Artificial Sequence
  Description of Artificial Sequence: Synthetic oligonucleotide
  Target: ATXN1; (-) strand; PAM type: NNNNGHTT; PAM sequence: AGAAGCTT
ctgaaactgaaatgaatagc

SEQ ID NO: 32309 - DNA, 20 bp, Artificial Sequence
  Description of Artificial Sequence: Synthetic oligonucleotide
  Target: ATXN1; (-) strand; PAM type: NNNNGHTT; PAM sequence: TTTAGTTT
ataaaaatatttgagatgaa

SEQ ID NO: 32310 - DNA, 20 bp, Artificial Sequence
  Description of Artificial Sequence: Synthetic oligonucleotide
  Target: ATXN1; (-) strand; PAM type: NNNNGHTT; PAM sequence: TGCAGATT
tggaggtggattggacagtt

SEQ ID NO: 32311 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
aatagagtggaggtggattg

SEQ ID NO: 32312 - DNA, 20 bp, Artificial Sequence
  Description of Artificial Sequence: Synthetic oligonucleotide
  Target: ATXN1; (-) strand; PAM type: NNNNGHTT; PAM sequence: GGTGGATT
atgtctaaaaatagagtgga

SEQ ID NO: 32313 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
tgccaacgtaaaattacaat

SEQ ID NO: 32314 - DNA, 20 bp, Artificial Sequence
  Description of Artificial Sequence: Synthetic oligonucleotide
  Target: ATXN1; (-) strand; PAM type: NNNNGHTT; PAM sequence: AACTGCTT
ttgttaaaatcacgtaaatt

SEQ ID NO: 32315 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
gactaactgtaatctgaatt

SEQ ID NO: 32316 - DNA, 20 bp, Artificial Sequence
  Description of Artificial Sequence: Synthetic oligonucleotide
  Target: ATXN1; (-) strand; PAM type: NNNNGHTT; PAM sequence: TTTAGCTT
ccatttgggtaatatacata

SEQ ID NO: 32317 - DNA, 20 bp, Artificial Sequence
  Description of Artificial Sequence: Synthetic oligonucleotide
  Target: ATXN1; (-) strand; PAM type: NNNNGHTT; PAM sequence: AATTGTTT
taaatgacacatttcttatt

SEQ ID NO: 32318 - DNA, 20 bp, Artificial Sequence
  Description of Artificial Sequence: Synthetic oligonucleotide
  Target: ATXN1; (-) strand; PAM type: NNNNGHTT; PAM sequence: TATGGCTT
tacagattttggtggcagtt

SEQ ID NO: 32319 - DNA, 20 bp, Artificial Sequence
  Description of Artificial Sequence: Synthetic oligonucleotide
  Target: ATXN1; (-) strand; PAM type: NNNNGHTT; PAM sequence: GGCAGTTT
aaatagttacagattttggt

SEQ ID NO: 32320 - DNA, 20 bp, Artificial Sequence
  Description of Artificial Sequence: Synthetic oligonucleotide
  Target: ATXN1; (-) strand; PAM type: NNNNGHTT; PAM sequence: TACAGATT
atcttgcaggaagaaatagt

SEQ ID NO: 32321 - DNA, 20 bp, Artificial Sequence
  Description of Artificial Sequence: Synthetic oligonucleotide
  Target: ATXN1; (-) strand; PAM type: NNNNGHTT; PAM sequence: TGGTGTTT
atgagacagtttcatgagta

SEQ ID NO: 32322 - DNA, 20 bp, Artificial Sequence
  Description of Artificial Sequence: Synthetic oligonucleotide
  Target: ATXN1; (-) strand; PAM type: NNNNGHTT; PAM sequence: GACAGTTT
ttcagtactaaaggtaatga

SEQ ID NO: 32323 - DNA, 20 bp, Artificial Sequence
  Description of Artificial Sequence: Synthetic oligonucleotide
  Target: ATXN1; (-) strand; PAM type: NNNNGHTT; PAM sequence: TTGTGATT
aaagaatcagtgcctgttat

SEQ ID NO: 32324 - DNA, 20 bp, Artificial Sequence
  Description of Artificial Sequence: Synthetic oligonucleotide
  Target: ATXN1; (-) strand; PAM type: NNNNGHTT; PAM sequence: TCTTGTTT
tttttatttgcacgagaaag

SEQ ID NO: 32325 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
ggaagctctgccctttttca

SEQ ID NO: 32326 - DNA, 20 bp, Artificial Sequence
  Description of Artificial Sequence: Synthetic oligonucleotide
  Target: ATXN1; (-) strand; PAM type: NNNNGHTT; PAM sequence: ACTAGCTT
atagtactatatatttgtct

SEQ ID NO: 32327 - DNA, 20 bp, Artificial Sequence
  Description of Artificial Sequence: Synthetic oligonucleotide
  Target: ATXN1; (-) strand; PAM type: NNNNGHTT; PAM sequence: TTATGCTT
ctgtaatttcaaaggttgac

SEQ ID NO: 32328 - DNA, 20 bp, Artificial Sequence
  Description of Artificial Sequence: Synthetic oligonucleotide
  Target: ATXN1; (-) strand; PAM type: NNNNGHTT; PAM sequence: TATCGATT
caagctcatcaggccttatt

SEQ ID NO: 32329 - DNA, 20 bp, Artificial Sequence
  Description of Artificial Sequence: Synthetic oligonucleotide
  Target: ATXN1; (-) strand; PAM type: NNNNGHTT; PAM sequence: ATGTGATT
accaaaacagtaaaatagat

SEQ ID NO: 32330 - DNA, 20 bp, Artificial Sequence
  Description of Artificial Sequence: Synthetic oligonucleotide
  Target: ATXN1; (-) strand; PAM type: NNNNGHTT; PAM sequence: TTCTGATT
gggcctggttcaaaggcaga

SEQ ID NO: 32331 - DNA, 20 bp, Artificial Sequence
  Description of Artificial Sequence: Synthetic oligonucleotide
  Target: ATXN1; (-) strand; PAM type: NNNNGHTT; PAM sequence: GGCAGATT
acccaggggcctggttcaaa

SEQ ID NO: 32332 - DNA, 20 bp, Artificial Sequence
  Description of Artificial Sequence: Synthetic oligonucleotide
  Target: ATXN1; (-) strand; PAM type: NNNNGHTT; PAM sequence: ATGTGTTT
ccagtgttcttcacatgata

SEQ ID NO: 32333 - DNA, 20 bp, Artificial Sequence
  Description of Artificial Sequence: Synthetic oligonucleotide
  Target: ATXN1; (-) strand; PAM type: NNNNGHTT; PAM sequence: ACTGGTTT
tgatttggagagacctgtgc

SEQ ID NO: 32334 - DNA, 20 bp, Artificial Sequence
  Description of Artificial Sequence: Synthetic oligonucleotide
  Target: ATXN1; (-) strand; PAM type: NNNNGHTT; PAM sequence: TCATGATT
atactacaatgtaaaatctg

SEQ ID NO: 32335 - DNA, 20 bp, Artificial Sequence
  Description of Artificial Sequence: Synthetic oligonucleotide
  Target: ATXN1; (-) strand; PAM type: NNNNGHTT; PAM sequence: ATTTGCTT
tatctgtgtttgctcagttg

SEQ ID NO: 32336 - DNA, 20 bp, Artificial Sequence
  Description of Artificial Sequence: Synthetic oligonucleotide
  Target: ATXN1; (-) strand; PAM type: NNNNGHTT; PAM sequence: AGTTGATT
aagcctatctgtgtttgctc

SEQ ID NO: 32337 - DNA, 20 bp, Artificial Sequence
  Description of Artificial Sequence: Synthetic oligonucleotide
  Target: ATXN1; (-) strand; PAM type: NNNNGHTT; PAM sequence: CTGTGTTT
ttatgacctggtaagcctat

SEQ ID NO: 32338 - DNA, 20 bp, Artificial Sequence
  Description of Artificial Sequence: Synthetic oligonucleotide
  Target: ATXN1; (-) strand; PAM type: NNNNGHTT; PAM sequence: AGAAGTTT
attcaagcctaaaactctaa

SEQ ID NO: 32339 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
ctgattctgtgttgtgttat

SEQ ID NO: 32340 - DNA, 20 bp, Artificial Sequence
  Description of Artificial Sequence: Synthetic oligonucleotide
  Target: ATXN1; (-) strand; PAM type: NNNNGHTT; PAM sequence: GCCTGATT
agctaaggcatcttagggtt

SEQ ID NO: 32341 - DNA, 20 bp, Artificial Sequence
  Description of Artificial Sequence: Synthetic oligonucleotide
  Target: ATXN1; (-) strand; PAM type: NNNNGHTT; PAM sequence: CTTTGTTT
gttgcctgattctgtgttat

SEQ ID NO: 32342 - DNA, 20 bp, Artificial Sequence
  Description of Artificial Sequence: Synthetic oligonucleotide
  Target: ATXN1; (-) strand; PAM type: NNNNGHTT; PAM sequence: GCCTGATT
caggagctactattagggtt

SEQ ID NO: 32343 - DNA, 20 bp, Artificial Sequence
  Description of Artificial Sequence: Synthetic oligonucleotide
  Target: ATXN1; (-) strand; PAM type: NNNNGHTT; PAM sequence: CTCTGTTT
tgtagggtccagtgaactga

SEQ ID NO: 32344 - DNA, 20 bp, Artificial Sequence
  Description of Artificial Sequence: Synthetic oligonucleotide
  Target: ATXN1; (-) strand; PAM type: NNNNGHTT; PAM sequence: GGGAGTTT
aagtatgttatctgcttcaa

SEQ ID NO: 32345 - DNA, 20 bp, Artificial Sequence
  Description of Artificial Sequence: Synthetic oligonucleotide
  Target: ATXN1; (-) strand; PAM type: NNNNGHTT; PAM sequence: ATCTGCTT
tggcttttaccaagtatgtt

SEQ ID NO: 32346 - DNA, 20 bp, Artificial Sequence
  Description of Artificial Sequence: Synthetic oligonucleotide
  Target: ATXN1; (-) strand; PAM type: NNNNGHTT; PAM sequence: CTTGGCTT
gttccataactttttggata

SEQ ID NO: 32347 - DNA, 20 bp, Artificial Sequence
  Description of Artificial Sequence: Synthetic oligonucleotide
  Target: ATXN1; (-) strand; PAM type: NNNNGHTT; PAM sequence: GACTGCTT
attgtagatgcagagtaagt

SEQ ID NO: 32348 - DNA, 20 bp, Artificial Sequence
  Description of Artificial Sequence: Synthetic oligonucleotide
  Target: ATXN1; (-) strand; PAM type: NNNNGHTT; PAM sequence: AACAGTTT
gtttcaacgtggtaaaaatt

SEQ ID NO: 32349 - DNA, 20 bp, Artificial Sequence
  Description of Artificial Sequence: Synthetic oligonucleotide
  Target: ATXN1; (-) strand; PAM type: NNNNGHTT; PAM sequence: TTGTGTTT
atcgcatcaactatgaatct

SEQ ID NO: 32350 - DNA, 20 bp, Artificial Sequence
  Description of Artificial Sequence: Synthetic oligonucleotide
  Target: ATXN1; (-) strand; PAM type: NNNNGHTT; PAM sequence: CTATGATT
catatttggaagtctgattg

SEQ ID NO: 32351 - DNA, 20 bp, Artificial Sequence
  Description of Artificial Sequence: Synthetic oligonucleotide
  Target: ATXN1; (-) strand; PAM type: NNNNGHTT; PAM sequence: GTCTGATT
tttgattctcatatttggaa

SEQ ID NO: 32352 - DNA, 20 bp, Artificial Sequence
  Description of Artificial Sequence: Synthetic oligonucleotide
  Target: ATXN1; (-) strand; PAM type: NNNNGHTT; PAM sequence: GTTTGATT
aaatttttaatgattctaat

SEQ ID NO: 32353 - DNA, 20 bp, Artificial Sequence
  Description of Artificial Sequence: Synthetic oligonucleotide
  Target: ATXN1; (-) strand; PAM type: NNNNGHTT; PAM sequence: TAATGTTT
tctcaaatttttaatgattc

SEQ ID NO: 32354 - DNA, 20 bp, Artificial Sequence
  Description of Artificial Sequence: Synthetic oligonucleotide
  Target: ATXN1; (-) strand; PAM type: NNNNGHTT; PAM sequence: TAATGATT
ccccccgcctctcaaatttt

SEQ ID NO: 32355 - DNA, 20 bp, Artificial Sequence
  Description of Artificial Sequence: Synthetic oligonucleotide
  Target: ATXN1; (-) strand; PAM type: NNNNGHTT; PAM sequence: ATTAGCTT
tacaaatttgaaatattaat

SEQ ID NO: 32356 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
aatacacattatatcttcac

SEQ ID NO: 32357 - DNA, 20 bp, Artificial Sequence
  Description of Artificial Sequence: Synthetic oligonucleotide
  Target: ATXN1; (-) strand; PAM type: NNNNGHTT; PAM sequence: ATGTGATT
tttaccaactcaacttactc

SEQ ID NO: 32358 - DNA, 20 bp, Artificial Sequence
  Description of Artificial Sequence: Synthetic oligonucleotide
  Target: ATXN1; (-) strand; PAM type: NNNNGHTT; PAM sequence: AAATGTTT
tagaaaagataaaaataaat

SEQ ID NO: 32359 - DNA, 20 bp, Artificial Sequence
  Description of Artificial Sequence: Synthetic oligonucleotide
  Target: ATXN1; (-) strand; PAM type: NNNNGHTT; PAM sequence: CTGGGATT
ccattaaaaattcaaacttt

SEQ ID NO: 32360 - DNA, 20 bp, Artificial Sequence
  Description of Artificial Sequence: Synthetic oligonucleotide
  Target: ATXN1; (-) strand; PAM type: NNNNGHTT; PAM sequence: CAGTGTTT
ttacaccctctttattctgt

SEQ ID NO: 32361 - DNA, 20 bp, Artificial Sequence
  Description of Artificial Sequence: Synthetic oligonucleotide
  Target: ATXN1; (-) strand; PAM type: NNNNGHTT; PAM sequence: GTAGGATT
cagatttttaaatgacatat

SEQ ID NO: 32362 - DNA, 20 bp, Artificial Sequence
  Description of Artificial Sequence: Synthetic oligonucleotide
  Target: ATXN1; (-) strand; PAM type: NNNNGHTT; PAM sequence: CTCAGATT
tgcaagcacactatggtttg

SEQ ID NO: 32363 - DNA, 20 bp, Artificial Sequence
  Description of Artificial Sequence: Synthetic oligonucleotide
  Target: ATXN1; (-) strand; PAM type: NNNNGHTT; PAM sequence: TATGGTTT
tatttgttttgcaagcacac

SEQ ID NO: 32364 - DNA, 20 bp, Artificial Sequence
  Description of Artificial Sequence: Synthetic oligonucleotide
  Target: ATXN1; (-) strand; PAM type: NNNNGHTT; PAM sequence: ATTTGTTT
gtgcaatctaaggaaagtat

SEQ ID NO: 32365 - DNA, 20 bp, Artificial Sequence
  Description of Artificial Sequence: Synthetic oligonucleotide
  Target: ATXN1; (-) strand; PAM type: NNNNGHTT; PAM sequence: GTTTGTTT
tgagtgtttttcacttttga

SEQ ID NO: 32366 - DNA, 20 bp, Artificial Sequence
  Description of Artificial Sequence: Synthetic oligonucleotide
  Target: ATXN1; (-) strand; PAM type: NNNNGHTT; PAM sequence: TTGAGTTT
tgtgtgagtgtttttcactt

SEQ ID NO: 32367 - DNA, 20 bp, Artificial Sequence
  Description of Artificial Sequence: Synthetic oligonucleotide
  Target: ATXN1; (-) strand; PAM type: NNNNGHTT; PAM sequence: GAGTGTTT
gacctcagagtctattgtgt

SEQ ID NO: 32368 - DNA, 20 bp, Artificial Sequence
  Description of Artificial Sequence: Synthetic oligonucleotide
  Target: ATXN1; (-) strand; PAM type: NNNNGHTT; PAM sequence: AGATGATT
gtttggtggagggtcaagaa

SEQ ID NO: 32369 - DNA, 20 bp, Artificial Sequence
  Description of Artificial Sequence: Synthetic oligonucleotide
  Target: ATXN1; (-) strand; PAM type: NNNNGHTT; PAM sequence: TACAGTTT
tcccaggaagcctgtcttgc

SEQ ID NO: 32370 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
gttcatgccataggccagac

SEQ ID NO: 32371 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
taagacaggtcttggttctc

SEQ ID NO: 32372 - DNA, 20 bp, Artificial Sequence
  Description of Artificial Sequence: Synthetic oligonucleotide
  Target: ATXN1; (+) strand; PAM type: NNNNGHTT; PAM sequence: CCTTGCTT
ttggttctcctctgattcca

SEQ ID NO: 32373 - DNA, 20 bp, Artificial Sequence
  Description of Artificial Sequence: Synthetic oligonucleotide
  Target: ATXN1; (+) strand; PAM type: NNNNGHTT; PAM sequence: TGGTGATT
cttcaatgaaatcaccttgc

SEQ ID NO: 32374 - DNA, 20 bp, Artificial Sequence
  Description of Artificial Sequence: Synthetic oligonucleotide
  Target: ATXN1; (+) strand; PAM type: NNNNGHTT; PAM sequence: ACTTGATT
tggtcgtcccccttgaagac

SEQ ID NO: 32375 - DNA, 20 bp, Artificial Sequence
  Description of Artificial Sequence: Synthetic oligonucleotide
  Target: ATXN1; (+) strand; PAM type: NNNNGHTT; PAM sequence: GGCTGTTT
gttgacgtaggaggacagga

SEQ ID NO: 32376 - DNA, 20 bp, Artificial Sequence
  Description of Artificial Sequence: Synthetic oligonucleotide
  Target: ATXN1; (+) strand; PAM type: NNNNGHTT; PAM sequence: GGTGGTTT
aggtagaatagaaaggtaaa

SEQ ID NO: 32377 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
gatggggtcagagggtgggg

SEQ ID NO: 32378 - DNA, 20 bp, Artificial Sequence
  Description of Artificial Sequence: Synthetic oligonucleotide
  Target: ATXN1; (+) strand; PAM type: NNNNGHTT; PAM sequence: ACCTGCTT
gctcgagtggaagcgtccaa

SEQ ID NO: 32379 - DNA, 20 bp, Artificial Sequence
  Description of Artificial Sequence: Synthetic oligonucleotide
  Target: ATXN1; (+) strand; PAM type: NNNNGHTT; PAM sequence: CAGAGCTT
tccccccaagtctgttccgt

SEQ ID NO: 32380 - DNA, 20 bp, Artificial Sequence
  Description of Artificial Sequence: Synthetic oligonucleotide
  Target: ATXN1; (+) strand; PAM type: NNNNGHTT; PAM sequence: GGAGGCTT
tcttctgtctcctgctgcct

SEQ ID NO: 32381 - DNA, 20 bp, Artificial Sequence
  Description of Artificial Sequence: Synthetic oligonucleotide
  Target: ATXN1; (+) strand; PAM type: NNNNGHTT; PAM sequence: CACCGATT
ctcggggcccagacgcaagg

SEQ ID NO: 32382 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
ttctctttctctctcccttt

SEQ ID NO: 32383 - DNA, 20 bp, Artificial Sequence
  Description of Artificial Sequence: Synthetic oligonucleotide
  Target: ATXN1; (+) strand; PAM type: NNNNGHTT; PAM sequence: GATGGTTT
ttctttcttttttaaaagaa

SEQ ID NO: 32384 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
ttaagacttaatggagttgc

SEQ ID NO: 32385 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
tatttccaggagtcaagttg

SEQ ID NO: 32386 - DNA, 20 bp, Artificial Sequence
  Description of Artificial Sequence: Synthetic oligonucleotide
  Target: ATXN1; (+) strand; PAM type: NNNNGHTT; PAM sequence: TTGGGATT
caggagtcaagttgaatggt

SEQ ID NO: 32387 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
gtcaagttgaatggtttggg

SEQ ID NO: 32388 - DNA, 20 bp, Artificial Sequence
  Description of Artificial Sequence: Synthetic oligonucleotide
  Target: ATXN1; (+) strand; PAM type: NNNNGHTT; PAM sequence: CGGCGATT
ggctgatggcaagcctctcc

SEQ ID NO: 32389 - DNA, 20 bp, Artificial Sequence
  Description of Artificial Sequence: Synthetic oligonucleotide
  Target: ATXN1; (+) strand; PAM type: NNNNGHTT; PAM sequence: TCTAGCTT
agtaactggcatccctcacc

SEQ ID NO: 32390 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
taactggacagatgaacatg

SEQ ID NO: 32391 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
atactcacaaagttgagcca

SEQ ID NO: 32392 - DNA, 20 bp, Artificial Sequence
  Description of Artificial Sequence: Synthetic oligonucleotide
  Target: ATXN1; (+) strand; PAM type: NNNNGHTT; PAM sequence: CCGAGTTT
gttgagccaatgtgttttcc

SEQ ID NO: 32393 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
ttttccccgagtttcattac

SEQ ID NO: 32394 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
gggacaagtcatctgtcgct

SEQ ID NO: 32395 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
ctctaggaagctgtccctgt

SEQ ID NO: 32396 - DNA, 20 bp, Artificial Sequence
  Description of Artificial Sequence: Synthetic oligonucleotide
  Target: ATXN1; (+) strand; PAM type: NNNNGHTT; PAM sequence: TTTCGTTT
gtccctgtcctggcttctca

SEQ ID NO: 32397 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tgtcctggcttctcatttcg

SEQ ID NO: 32398 - DNA, 20 bp, Artificial Sequence
  Description of Artificial Sequence: Synthetic oligonucleotide
  Target: ATXN1; (+) strand; PAM type: NNNNGHTT; PAM sequence: GGATGTTT
tcttaatttgaaattccaca

SEQ ID NO: 32399 - DNA, 20 bp, Artificial Sequence
  Description of Artificial Sequence: Synthetic oligonucleotide
  Target: ATXN1; (+) strand; PAM type: NNNNGHTT; PAM sequence: CAAAGCTT
gagtcacactgaaaaagagc

SEQ ID NO: 32400 - DNA, 20 bp, Artificial Sequence
  Description of Artificial Sequence: Synthetic oligonucleotide
  Target: ATXN1; (+) strand; PAM type: NNNNGHTT; PAM sequence: ATTGGTTT
tcagtggcatcctaaaaggc

SEQ ID NO: 32401 - DNA, 20 bp, Artificial Sequence
  Description of Artificial Sequence: Synthetic oligonucleotide
  Target: ATXN1; (+) strand; PAM type: NNNNGHTT; PAM sequence: GGATGCTT
tgacctgcagcagtccacca

SEQ ID NO: 32402 - DNA, 20 bp, Artificial Sequence
  Description of Artificial Sequence: Synthetic oligonucleotide
  Target: ATXN1; (+) strand; PAM type: NNNNGHTT; PAM sequence: GCTTGTTT
ctgcagcagtccaccaggat

SEQ ID NO: 32403 - DNA, 20 bp, Artificial Sequence
  Description of Artificial Sequence: Synthetic oligonucleotide
  Target: ATXN1; (+) strand; PAM type: NNNNGHTT; PAM sequence: GGTTGTTT
tggaaagcgtatgcagatca

SEQ ID NO: 32404 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
atgcagatcaggttgtttta

SEQ ID NO: 32405 - DNA, 20 bp, Artificial Sequence
  Description of Artificial Sequence: Synthetic oligonucleotide
  Target: ATXN1; (+) strand; PAM type: NNNNGHTT; PAM sequence: GTCAGTTT
gctgaagagcagatacacaa

SEQ ID NO: 32406 - DNA, 20 bp, Artificial Sequence
  Description of Artificial Sequence: Synthetic oligonucleotide
  Target: ATXN1; (+) strand; PAM type: NNNNGHTT; PAM sequence: GCCTGATT
tgtgccagggtgaatgaatg

SEQ ID NO: 32407 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
acaggcccactgttggtcct

SEQ ID NO: 32408 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
ccactgttggtcctttaaga

SEQ ID NO: 32409 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
tttcccctactaaatccatt

SEQ ID NO: 32410 - DNA, 20 bp, Artificial Sequence
  Description of Artificial Sequence: Synthetic oligonucleotide
  Target: ATXN1; (+) strand; PAM type: NNNNGHTT; PAM sequence: CTAGGATT
gcgtcaacctccccaaagtg

SEQ ID NO: 32411 - DNA, 20 bp, Artificial Sequence
  Description of Artificial Sequence: Synthetic oligonucleotide
  Target: ATXN1; (+) strand; PAM type: NNNNGHTT; PAM sequence: AGGCGATT
ttggagacgggagggccaag

SEQ ID NO: 32412 - DNA, 20 bp, Artificial Sequence
  Description of Artificial Sequence: Synthetic oligonucleotide
  Target: ATXN1; (+) strand; PAM type: NNNNGHTT; PAM sequence: TGGGGCTT
atttaacgtggagcaagaca

SEQ ID NO: 32413 - DNA, 20 bp, Artificial Sequence
  Description of Artificial Sequence: Synthetic oligonucleotide
  Target: ATXN1; (+) strand; PAM type: NNNNGHTT; PAM sequence: AGCTGCTT
cttgctctctgtggtcttcc

SEQ ID NO: 32414 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
aacctccgcctcccaggttc

SEQ ID NO: 32415 - DNA, 20 bp, Artificial Sequence
  Description of Artificial Sequence: Synthetic oligonucleotide
  Target: ATXN1; (+) strand; PAM type: NNNNGHTT; PAM sequence: CCGGGATT
tgcctcagccttcagagtag

SEQ ID NO: 32416 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
aggtgcccgccacgtctggc

SEQ ID NO: 32417 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
ccgccacgtctggctaatgt

SEQ ID NO: 32418 - DNA, 20 bp, Artificial Sequence
  Description of Artificial Sequence: Synthetic oligonucleotide
  Target: ATXN1; (+) strand; PAM type: NNNNGHTT; PAM sequence: ATGGGTTT
tgtttatgtttttagtagag

SEQ ID NO: 32419 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacctcagcctcccaaagtg

SEQ ID NO: 32420 - DNA, 20 bp, Artificial Sequence
  Description of Artificial Sequence: Synthetic oligonucleotide
  Target: ATXN1; (+) strand; PAM type: NNNNGHTT; PAM sequence: CACCGTTT
gagaacttgtaaggctccgt

SEQ ID NO: 32421 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
caggacctggagatgaagca

SEQ ID NO: 32422 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
gcagctttgctgctgaccca

SEQ ID NO: 32423 - DNA, 20 bp, Artificial Sequence
  Description of Artificial Sequence: Synthetic oligonucleotide
  Target: ATXN1; (+) strand; PAM type: NNNNGHTT; PAM sequence: CAGTGCTT
gttccatctgagggctctgg

SEQ ID NO: 32424 - DNA, 20 bp, Artificial Sequence
  Description of Artificial Sequence: Synthetic oligonucleotide
  Target: ATXN1; (+) strand; PAM type: NNNNGHTT; PAM sequence: GATGGTTT
agggctctggcagtgctttt

SEQ ID NO: 32425 - DNA, 20 bp, Artificial Sequence
  Description of Artificial Sequence: Synthetic oligonucleotide
  Target: ATXN1; (+) strand; PAM type: NNNNGHTT; PAM sequence: AATTGATT
ctgaaggtatggttccccct

SEQ ID NO: 32426 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
aaagggaaggcagagatgca

SEQ ID NO: 32427 - DNA, 20 bp, Artificial Sequence
  Description of Artificial Sequence: Synthetic oligonucleotide
  Target: ATXN1; (+) strand; PAM type: NNNNGHTT; PAM sequence: CCGAGTTT
cagagatgcagactgctttg

SEQ ID NO: 32428 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
ctgagttgcacctacacagc

SEQ ID NO: 32429 - DNA, 20 bp, Artificial Sequence
  Description of Artificial Sequence: Synthetic oligonucleotide
  Target: ATXN1; (+) strand; PAM type: NNNNGHTT; PAM sequence: AGGGGATT
aggtgggttgaggtgggtgc

SEQ ID NO: 32430 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
tgagagacctgctcgaggag

SEQ ID NO: 32431 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ctcgaggagttgggtttttt

SEQ ID NO: 32432 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
ttttttttttgtttttgagg

SEQ ID NO: 32433 - DNA, 20 bp, Artificial Sequence
  Description of Artificial Sequence: Synthetic oligonucleotide
  Target: ATXN1; (+) strand; PAM type: NNNNGHTT; PAM sequence: GTATGATT
gcccaggctggagtgcagcg

SEQ ID NO: 32434 - DNA, 20 bp, Artificial Sequence
  Description of Artificial Sequence: Synthetic oligonucleotide
  Target: ATXN1; (+) strand; PAM type: NNNNGHTT; PAM sequence: TTGGGATT
tgcctcggcctccccaactg

SEQ ID NO: 32435 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
gtctgctcgctgaatttcta

SEQ ID NO: 32436 - DNA, 20 bp, Artificial Sequence
  Description of Artificial Sequence: Synthetic oligonucleotide
  Target: ATXN1; (+) strand; PAM type: NNNNGHTT; PAM sequence: ACCAGTTT
tttccacttacagaccacta

SEQ ID NO: 32437 - DNA, 20 bp, Artificial Sequence
  Description of Artificial Sequence: Synthetic oligonucleotide
  Target: ATXN1; (+) strand; PAM type: NNNNGHTT; PAM sequence: TATAGATT
gagcaaatctgtaaggagtg

SEQ ID NO: 32438 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
cacgagcgcatgaagctacc

SEQ ID NO: 32439 - DNA, 20 bp, Artificial Sequence
  Description of Artificial Sequence: Synthetic oligonucleotide
  Target: ATXN1; (+) strand; PAM type: NNNNGHTT; PAM sequence: CATTGTTT
tgttcaaattttgaatcaaa

SEQ ID NO: 32440 - DNA, 20 bp, Artificial Sequence
  Description of Artificial Sequence: Synthetic oligonucleotide
  Target: ATXN1; (+) strand; PAM type: NNNNGHTT; PAM sequence: CCACGATT
gtatcctacaaatagacaca

SEQ ID NO: 32441 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
gaattcttccattttttaat

SEQ ID NO: 32442 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
ccctcaacccaagttctggt

SEQ ID NO: 32443 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
tcctttcggctgacactaat

SEQ ID NO: 32444 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
caagttcaaatgcactaact

SEQ ID NO: 32445 - DNA, 20 bp, Artificial Sequence
  Description of Artificial Sequence: Synthetic oligonucleotide
  Target: ATXN1; (+) strand; PAM type: NNNNGHTT; PAM sequence: CCGAGCTT
aaccagagaaaacctgtgca

SEQ ID NO: 32446 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
ttggtaactgctctgaagac

SEQ ID NO: 32447 - DNA, 20 bp, Artificial Sequence
  Description of Artificial Sequence: Synthetic oligonucleotide
  Target: ATXN1; (+) strand; PAM type: NNNNGHTT; PAM sequence: TAAGGATT
aggacagtatgttatcttgg

SEQ ID NO: 32448 - DNA, 20 bp, Artificial Sequence
  Description of Artificial Sequence: Synthetic oligonucleotide
  Target: ATXN1; (+) strand; PAM type: NNNNGHTT; PAM sequence: TTCAGATT
caacacttccaacgaaggcc

SEQ ID NO: 32449 - DNA, 20 bp, Artificial Sequence
  Description of Artificial Sequence: Synthetic oligonucleotide
  Target: ATXN1; (+) strand; PAM type: NNNNGHTT; PAM sequence: TAGAGATT
agaaaagttatggaaattct

SEQ ID NO: 32450 - DNA, 20 bp, Artificial Sequence
  Description of Artificial Sequence: Synthetic oligonucleotide
  Target: ATXN1; (+) strand; PAM type: NNNNGHTT; PAM sequence: ACGAGATT
cttcaacgagaagggagggg

SEQ ID NO: 32451 - DNA, 20 bp, Artificial Sequence
  Description of Artificial Sequence: Synthetic oligonucleotide
  Target: ATXN1; (+) strand; PAM type: NNNNGHTT; PAM sequence: GGGTGCTT
aatttaagaattgtaagtgg

SEQ ID NO: 32452 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
gcttaatatccccacagctg

SEQ ID NO: 32453 - DNA, 20 bp, Artificial Sequence
  Description of Artificial Sequence: Synthetic oligonucleotide
  Target: ATXN1; (+) strand; PAM type: NNNNGHTT; PAM sequence: TCCGGCTT
cagctgtccagtttccactg

SEQ ID NO: 32454 - DNA, 20 bp, Artificial Sequence
  Description of Artificial Sequence: Synthetic oligonucleotide
  Target: ATXN1; (+) strand; PAM type: NNNNGHTT; PAM sequence: GCTTGATT
tgtccagtttccactgtccg

SEQ ID NO: 32455 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
atgaggcatttacattgaaa

SEQ ID NO: 32456 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
ttttttgtccccataatgag

SEQ ID NO: 32457 - DNA, 20 bp, Artificial Sequence
  Description of Artificial Sequence: Synthetic oligonucleotide
  Target: ATXN1; (+) strand; PAM type: NNNNGHTT; PAM sequence: GTTTGATT
ttgtccccataatgagtcct

SEQ ID NO: 32458 - DNA, 20 bp, Artificial Sequence
  Description of Artificial Sequence: Synthetic oligonucleotide
  Target: ATXN1; (+) strand; PAM type: NNNNGHTT; PAM sequence: TCAAGATT
ttgttacaaacacttcgtgt

SEQ ID NO: 32459 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
cgtgttcaagattatattct

SEQ ID NO: 32460 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
tctgaagaaaaagaagttgc

SEQ ID NO: 32461 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
aaaagaagttgcaatggctt

SEQ ID NO: 32462 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
aaaataacaataagcatagg

SEQ ID NO: 32463 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
acatgtaactttcaaccctt

SEQ ID NO: 32464 - DNA, 20 bp, Artificial Sequence
  Description of Artificial Sequence: Synthetic oligonucleotide
  Target: ATXN1; (+) strand; PAM type: NNNNGHTT; PAM sequence: CATTGTTT
tacaaacaaagtatgaaact

SEQ ID NO: 32465 - DNA, 20 bp, Artificial Sequence
  Description of Artificial Sequence: Synthetic oligonucleotide
  Target: ATXN1; (+) strand; PAM type: NNNNGHTT; PAM sequence: GAGTGCTT
ttacctgtactcctcaaagt

SEQ ID NO: 32466 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tcaaagtgagtgcttcaaaa

SEQ ID NO: 32467 - DNA, 20 bp, Artificial Sequence
  Description of Artificial Sequence: Synthetic oligonucleotide
  Target: ATXN1; (+) strand; PAM type: NNNNGHTT; PAM sequence: TTCAGCTT
tgcttcaaaattttgttttc

SEQ ID NO: 32468 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
ctccggagtagaggtgtgca

SEQ ID NO: 32469 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
gtagaggtgtgcaagttgtt

SEQ ID NO: 32470 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
cccaacacaatagcagatgc

SEQ ID NO: 32471 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
tgggccatggagtctgctgg

SEQ ID NO: 32472 - DNA, 20 bp, Artificial Sequence
  Description of Artificial Sequence: Synthetic oligonucleotide
  Target: ATXN1; (+) strand; PAM type: NNNNGHTT; PAM sequence: AAGGGTTT
ctggtgcaaattgaagtgca

SEQ ID NO: 32473 - DNA, 20 bp, Artificial Sequence
  Description of Artificial Sequence: Synthetic oligonucleotide
  Target: ATXN1; (+) strand; PAM type: NNNNGHTT; PAM sequence: AGCTGCTT
ggcaacagaccagtctgttg

SEQ ID NO: 32474 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
ccggccttcggtaccgagag

SEQ ID NO: 32475 - DNA, 20 bp, Artificial Sequence
  Description of Artificial Sequence: Synthetic oligonucleotide
  Target: ATXN1; (+) strand; PAM type: NNNNGHTT; PAM sequence: TGGAGATT
attagtgtcttcaaaagcat

SEQ ID NO: 32476 - DNA, 20 bp, Artificial Sequence
  Description of Artificial Sequence: Synthetic oligonucleotide
  Target: ATXN1; (+) strand; PAM type: NNNNGHTT; PAM sequence: ATAGGTTT
tttttctctctatgaaagaa

SEQ ID NO: 32477 - DNA, 20 bp, Artificial Sequence
  Description of Artificial Sequence: Synthetic oligonucleotide
  Target: ATXN1; (+) strand; PAM type: NNNNGHTT; PAM sequence: AATCGTTT
agatgttaaagggtattgtc

SEQ ID NO: 32478 - DNA, 20 bp, Artificial Sequence
  Description of Artificial Sequence: Synthetic oligonucleotide
  Target: ATXN1; (+) strand; PAM type: NNNNGHTT; PAM sequence: AGTGGATT
aaagatcaaactgtgcaaag

SEQ ID NO: 32479 - DNA, 20 bp, Artificial Sequence
  Description of Artificial Sequence: Synthetic oligonucleotide
  Target: ATXN1; (+) strand; PAM type: NNNNGHTT; PAM sequence: TTATGATT
aactgtgcaaagagtggatt

SEQ ID NO: 32480 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
ctactccagagcagtcaaag

SEQ ID NO: 32481 - DNA, 20 bp, Artificial Sequence
  Description of Artificial Sequence: Synthetic oligonucleotide
  Target: ATXN1; (+) strand; PAM type: NNNNGHTT; PAM sequence: TTTGGATT
aagtccaaatgaaaattcaa

SEQ ID NO: 32482 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
aaatccctagaaagagaggt

SEQ ID NO: 32483 - DNA, 20 bp, Artificial Sequence
  Description of Artificial Sequence: Synthetic oligonucleotide
  Target: ATXN1; (+) strand; PAM type: NNNNGHTT; PAM sequence: GTTGGTTT
agaaagagaggttcttgttt

SEQ ID NO: 32484 - DNA, 20 bp, Artificial Sequence
  Description of Artificial Sequence: Synthetic oligonucleotide
  Target: ATXN1; (+) strand; PAM type: NNNNGHTT; PAM sequence: TGGTGATT
tttcgccctgactaatttct

SEQ ID NO: 32485 - DNA, 20 bp, Artificial Sequence
  Description of Artificial Sequence: Synthetic oligonucleotide
  Target: ATXN1; (+) strand; PAM type: NNNNGHTT; PAM sequence: ACTAGTTT
aacgcaaaaggcctgctgtt

SEQ ID NO: 32486 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
atttctacccctgtcatcgt

SEQ ID NO: 32487 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
aaggaaaaagccaaaaggga

SEQ ID NO: 32488 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
gcaagagaatgaaatgggac

SEQ ID NO: 32489 - DNA, 20 bp, Artificial Sequence
  Description of Artificial Sequence: Synthetic oligonucleotide
  Target: ATXN1; (+) strand; PAM type: NNNNGHTT; PAM sequence: GTGTGTTT
ttcctattgctccaaaccat

SEQ ID NO: 32490 - DNA, 20 bp, Artificial Sequence
  Description of Artificial Sequence: Synthetic oligonucleotide
  Target: ATXN1; (+) strand; PAM type: NNNNGHTT; PAM sequence: GTTGGTTT
gtgtgttttcccatcttagt

SEQ ID NO: 32491 - DNA, 20 bp, Artificial Sequence
  Description of Artificial Sequence: Synthetic oligonucleotide
  Target: ATXN1; (+) strand; PAM type: NNNNGHTT; PAM sequence: GTGTGTTT
gaagtaagccaaaaggtggt

SEQ ID NO: 32492 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
gtgccctgagcagaatatat

SEQ ID NO: 32493 - DNA, 20 bp, Artificial Sequence
  Description of Artificial Sequence: Synthetic oligonucleotide
  Target: ATXN1; (+) strand; PAM type: NNNNGHTT; PAM sequence: AAACGTTT
taagcaagttctctgaacag

SEQ ID NO: 32494 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
tagctattctaaacctattc

SEQ ID NO: 32495 - DNA, 20 bp, Artificial Sequence
  Description of Artificial Sequence: Synthetic oligonucleotide
  Target: ATXN1; (+) strand; PAM type: NNNNGHTT; PAM sequence: AACGGTTT
gtttttggtacaccccagaa

SEQ ID NO: 32496 - DNA, 20 bp, Artificial Sequence
  Description of Artificial Sequence: Synthetic oligonucleotide
  Target: ATXN1; (+) strand; PAM type: NNNNGHTT; PAM sequence: ACCAGATT
cagccaaaatgtgggttgat

SEQ ID NO: 32497 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
aaagaaaagtcaggtatttg

SEQ ID NO: 32498 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
atttcggatctctgggaatg

SEQ ID NO: 32499 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
aaaactatgaaatacccttt

SEQ ID NO: 32500 - DNA, 20 bp, Artificial Sequence
  Description of Artificial Sequence: Synthetic oligonucleotide
  Target: ATXN1; (+) strand; PAM type: NNNNGHTT; PAM sequence: TCTCGATT
ggtttgtaccaaacattaaa

SEQ ID NO: 32501 - DNA, 20 bp, Artificial Sequence
  Description of Artificial Sequence: Synthetic oligonucleotide
  Target: ATXN1; (+) strand; PAM type: NNNNGHTT; PAM sequence: ATTTGATT
gtaccaaacattaaatctcg

SEQ ID NO: 32502 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
aataacaacaataataaagt

SEQ ID NO: 32503 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
atgaatctgaagaaaattct

SEQ ID NO: 32504 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
tttctaagagcccgctaaga

SEQ ID NO: 32505 - DNA, 20 bp, Artificial Sequence
  Description of Artificial Sequence: Synthetic oligonucleotide
  Target: ATXN1; (+) strand; PAM type: NNNNGHTT; PAM sequence: TAGAGTTT
cataaccttataaaatggcc

SEQ ID NO: 32506 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
ctcttctccatcccttttct

SEQ ID NO: 32507 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
ccaactctgcatatgccttg

SEQ ID NO: 32508 - DNA, 20 bp, Artificial Sequence
  Description of Artificial Sequence: Synthetic oligonucleotide
  Target: ATXN1; (+) strand; PAM type: NNNNGHTT; PAM sequence: CTTAGTTT
tgttgaaaaaaagaaagcaa

SEQ ID NO: 32509 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
aaagaaagcaacttagtttt

SEQ ID NO: 32510 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
agcaacttagttttttttgt

SEQ ID NO: 32511 - DNA, 20 bp, Artificial Sequence
  Description of Artificial Sequence: Synthetic oligonucleotide
  Target: ATXN1; (+) strand; PAM type: NNNNGHTT; PAM sequence: AAGAGTTT
ttgtttttgttttttcccca

SEQ ID NO: 32512 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
acttgttgaatgagagacca

SEQ ID NO: 32513 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
aaagtgtgaacagtattttt

SEQ ID NO: 32514 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
agtactagagttcaaagaca

SEQ ID NO: 32515 - DNA, 20 bp, Artificial Sequence
  Description of Artificial Sequence: Synthetic oligonucleotide
  Target: ATXN1; (+) strand; PAM type: NNNNGHTT; PAM sequence: AAGAGCTT
gatttcgcaaactcaacgtg

SEQ ID NO: 32516 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
ttctgttgctctcactgaag

SEQ ID NO: 32517 - DNA, 20 bp, Artificial Sequence
  Description of Artificial Sequence: Synthetic oligonucleotide
  Target: ATXN1; (+) strand; PAM type: NNNNGHTT; PAM sequence: ACCTGATT
ggagtgaagtcaatgcaata

SEQ ID NO: 32518 - DNA, 20 bp, Artificial Sequence
  Description of Artificial Sequence: Synthetic oligonucleotide
  Target: ATXN1; (+) strand; PAM type: NNNNGHTT; PAM sequence: ATTGGTTT
gaagtcaatgcaataacctg

SEQ ID NO: 32519 - DNA, 20 bp, Artificial Sequence
  Description of Artificial Sequence: Synthetic oligonucleotide
  Target: ATXN1; (+) strand; PAM type: NNNNGHTT; PAM sequence: AGGGGCTT
ccatgtggggccatgacagc

SEQ ID NO: 32520 - DNA, 20 bp, Artificial Sequence
  Description of Artificial Sequence: Synthetic oligonucleotide
  Target: ATXN1; (+) strand; PAM type: NNNNGHTT; PAM sequence: AGTTGCTT
tatatatctatacaattaaa

SEQ ID NO: 32521 - DNA, 20 bp, Artificial Sequence
  Description of Artificial Sequence: Synthetic oligonucleotide
  Target: ATXN1; (+) strand; PAM type: NNNNGHTT; PAM sequence: TGTTGATT
ccctgaagctgggttcctga

SEQ ID NO: 32522 - DNA, 20 bp, Artificial Sequence
  Description of Artificial Sequence: Synthetic oligonucleotide
  Target: ATXN1; (+) strand; PAM type: NNNNGHTT; PAM sequence: GGCTGCTT
tagcgggagtcagcgccccc

SEQ ID NO: 32523 - DNA, 20 bp, Artificial Sequence
  Description of Artificial Sequence: Synthetic oligonucleotide
  Target: ATXN1; (+) strand; PAM type: NNNNGHTT; PAM sequence: CCACGTTT
atacaaatgataagggagag

SEQ ID NO: 32524 - DNA, 20 bp, Artificial Sequence
  Description of Artificial Sequence: Synthetic oligonucleotide
  Target: ATXN1; (+) strand; PAM type: NNNNGHTT; PAM sequence: GAAGGCTT
taacctcctgaggaattaga

SEQ ID NO: 32525 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
gtggttcgtcttctgacttc

SEQ ID NO: 32526 - DNA, 20 bp, Artificial Sequence
  Description of Artificial Sequence: Synthetic oligonucleotide
  Target: ATXN1; (+) strand; PAM type: NNNNGHTT; PAM sequence: GCGGGCTT
acctcctcttcctcgttgcc

SEQ ID NO: 32527 - DNA, 20 bp, Artificial Sequence
  Description of Artificial Sequence: Synthetic oligonucleotide
  Target: ATXN1; (+) strand; PAM type: NNNNGHTT; PAM sequence: GGTTGATT
gagcatctgggcactcccct

SEQ ID NO: 32528 - DNA, 20 bp, Artificial Sequence
  Description of Artificial Sequence: Synthetic oligonucleotide
  Target: ATXN1; (+) strand; PAM type: NNNNGHTT; PAM sequence: TTCCGTTT
ctgggcactcccctggttga

SEQ ID NO: 32529 - DNA, 20 bp, Artificial Sequence
  Description of Artificial Sequence: Synthetic oligonucleotide
  Target: ATXN1; (+) strand; PAM type: NNNNGHTT; PAM sequence: GAGTGCTT
ccgccaggccgtcggccttt

SEQ ID NO: 32530 - DNA, 20 bp, Artificial Sequence
  Description of Artificial Sequence: Synthetic oligonucleotide
  Target: ATXN1; (+) strand; PAM type: NNNNGHTT; PAM sequence: GAGAGTTT
agatgcagacatccccaact

SEQ ID NO: 32531 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
aacaaatgaaaacattttat

SEQ ID NO: 32532 - DNA, 20 bp, Artificial Sequence
  Description of Artificial Sequence: Synthetic oligonucleotide
  Target: ATXN1; (+) strand; PAM type: NNNNGHTT; PAM sequence: GTTTGATT
aatgaaaacattttattctt

SEQ ID NO: 32533 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
ggctgaatgggggaaaatga

SEQ ID NO: 32534 - DNA, 20 bp, Artificial Sequence
  Description of Artificial Sequence: Synthetic oligonucleotide
  Target: ATXN1; (+) strand; PAM type: NNNNGHTT; PAM sequence: CTTAGCTT
cagtaatgacagagcaccca

SEQ ID NO: 32535 - DNA, 20 bp, Artificial Sequence
  Description of Artificial Sequence: Synthetic oligonucleotide
  Target: ATXN1; (+) strand; PAM type: NNNNGHTT; PAM sequence: CTTAGATT
gctcacaagcccagcgcggt

SEQ ID NO: 32536 - DNA, 20 bp, Artificial Sequence
  Description of Artificial Sequence: Synthetic oligonucleotide
  Target: ATXN1; (+) strand; PAM type: NNNNGHTT; PAM sequence: GTGTGTTT
agttccaagaagcaggcaca

SEQ ID NO: 32537 - DNA, 20 bp, Artificial Sequence
  Description of Artificial Sequence: Synthetic oligonucleotide
  Target: ATXN1; (+) strand; PAM type: NNNNGHTT; PAM sequence: GGATGCTT
tgagtccccagcccctaaaa

SEQ ID NO: 32538 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
aaatttaaaaactctggaca

SEQ ID NO: 32539 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
cgcgtggatcacctgaggtc

SEQ ID NO: 32540 - DNA, 20 bp, Artificial Sequence
  Description of Artificial Sequence: Synthetic oligonucleotide
  Target: ATXN1; (+) strand; PAM type: NNNNGHTT; PAM sequence: AATCGTTT
tcaggaggctgaggcaggag

SEQ ID NO: 32541 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tcaggaggctgaggcaagag

SEQ ID NO: 32542 - DNA, 20 bp, Artificial Sequence
  Description of Artificial Sequence: Synthetic oligonucleotide
  Target: ATXN1; (+) strand; PAM type: NNNNGHTT; PAM sequence: GCCTGTTT
aggtgaagctggtgttgggg

SEQ ID NO: 32543 - DNA, 20 bp, Artificial Sequence
  Description of Artificial Sequence: Synthetic oligonucleotide
  Target: ATXN1; (+) strand; PAM type: NNNNGHTT; PAM sequence: GTGGGCTT
tggagcagttgggaaaccaa

SEQ ID NO: 32544 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
aggcctttcaaggtctgaag

SEQ ID NO: 32545 - DNA, 20 bp, Artificial Sequence
  Description of Artificial Sequence: Synthetic oligonucleotide
  Target: ATXN1; (+) strand; PAM type: NNNNGHTT; PAM sequence: ACTGGATT
gactcatctgagtccctaaa

SEQ ID NO: 32546 - DNA, 20 bp, Artificial Sequence
  Description of Artificial Sequence: Synthetic oligonucleotide
  Target: ATXN1; (+) strand; PAM type: NNNNGHTT; PAM sequence: GATAGCTT
tggtggtcatgaggagacca

SEQ ID NO: 32547 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
gatcttaaaaaaggatgcac

SEQ ID NO: 32548 - DNA, 20 bp, Artificial Sequence
  Description of Artificial Sequence: Synthetic oligonucleotide
  Target: ATXN1; (+) strand; PAM type: NNNNGHTT; PAM sequence: CTATGCTT
acatatagactttacaaaga

SEQ ID NO: 32549 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
gactatgcttacaataatta

SEQ ID NO: 32550 - DNA, 20 bp, Artificial Sequence
  Description of Artificial Sequence: Synthetic oligonucleotide
  Target: ATXN1; (+) strand; PAM type: NNNNGHTT; PAM sequence: GACAGCTT
caataattaagaagattaaa

SEQ ID NO: 32551 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
aattttgataggaaactaga

SEQ ID NO: 32552 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
agggaggatcacttgaggcc

SEQ ID NO: 32553 - DNA, 20 bp, Artificial Sequence
  Description of Artificial Sequence: Synthetic oligonucleotide
  Target: ATXN1; (+) strand; PAM type: NNNNGHTT; PAM sequence: CCCCGTTT
gtctgggcaacaaaatgaga

SEQ ID NO: 32554 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
ccactgaaatcaagaatgca

SEQ ID NO: 32555 - DNA, 20 bp, Artificial Sequence
  Description of Artificial Sequence: Synthetic oligonucleotide
  Target: ATXN1; (+) strand; PAM type: NNNNGHTT; PAM sequence: CATGGATT
gagctttccagttgaataga

SEQ ID NO: 32556 - DNA, 20 bp, Artificial Sequence
  Description of Artificial Sequence: Synthetic oligonucleotide
  Target: ATXN1; (+) strand; PAM type: NNNNGHTT; PAM sequence: ACTGGATT
gattaagaaagaattcagga

SEQ ID NO: 32557 - DNA, 20 bp, Artificial Sequence
  Description of Artificial Sequence: Synthetic oligonucleotide
  Target: ATXN1; (+) strand; PAM type: NNNNGHTT; PAM sequence: TAGAGCTT
caggaactggattctctaat

SEQ ID NO: 32558 - DNA, 20 bp, Artificial Sequence
  Description of Artificial Sequence: Synthetic oligonucleotide
  Target: ATXN1; (+) strand; PAM type: NNNNGHTT; PAM sequence: GACAGTTT
aaactgaagaaggataataa

SEQ ID NO: 32559 - DNA, 20 bp, Artificial Sequence
  Description of Artificial Sequence: Synthetic oligonucleotide
  Target: ATXN1; (+) strand; PAM type: NNNNGHTT; PAM sequence: GGTGGATT
cactttgggaggccgaggtg

SEQ ID NO: 32560 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
tgggtggattacctgaggtc

SEQ ID NO: 32561 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
aaataagcaacaatggaact

SEQ ID NO: 32562 - DNA, 20 bp, Artificial Sequence
  Description of Artificial Sequence: Synthetic oligonucleotide
  Target: ATXN1; (+) strand; PAM type: NNNNGHTT; PAM sequence: TCTAGATT
ttaggtagagaaaaaacaaa

SEQ ID NO: 32563 - DNA, 20 bp, Artificial Sequence
  Description of Artificial Sequence: Synthetic oligonucleotide
  Target: ATXN1; (+) strand; PAM type: NNNNGHTT; PAM sequence: TGAAGTTT
gagaaaaaacaaatctagat

SEQ ID NO: 32564 - DNA, 20 bp, Artificial Sequence
  Description of Artificial Sequence: Synthetic oligonucleotide
  Target: ATXN1; (+) strand; PAM type: NNNNGHTT; PAM sequence: GTTGGATT
gtaacaatatttaaaatatt

SEQ ID NO: 32565 - DNA, 20 bp, Artificial Sequence
  Description of Artificial Sequence: Synthetic oligonucleotide
  Target: ATXN1; (+) strand; PAM type: NNNNGHTT; PAM sequence: GGGGGCTT
ttttgtatttttagtagagt

SEQ ID NO: 32566 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgcctcagtctcccaaagtg

SEQ ID NO: 32567 - DNA, 20 bp, Artificial Sequence
  Description of Artificial Sequence: Synthetic oligonucleotide
  Target: ATXN1; (+) strand; PAM type: NNNNGHTT; PAM sequence: ATTGGATT
agccaccgtgtcaggcctcc

SEQ ID NO: 32568 - DNA, 20 bp, Artificial Sequence
  Description of Artificial Sequence: Synthetic oligonucleotide
  Target: ATXN1; (+) strand; PAM type: NNNNGHTT; PAM sequence: AGTAGATT
accaaaaaaactttaaaagt

SEQ ID NO: 32569 - DNA, 20 bp, Artificial Sequence
  Description of Artificial Sequence: Synthetic oligonucleotide
  Target: ATXN1; (+) strand; PAM type: NNNNGHTT; PAM sequence: CACAGATT
ctttaaaagtagtagatttc

SEQ ID NO: 32570 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
agtagtagatttccacagat

SEQ ID NO: 32571 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
ttgcttttctacttcatctt

SEQ ID NO: 32572 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
ttctttgtttcctttgttaa

SEQ ID NO: 32573 - DNA, 20 bp, Artificial Sequence
  Description of Artificial Sequence: Synthetic oligonucleotide
  Target: ATXN1; (+) strand; PAM type: NNNNGHTT; PAM sequence: GGCAGCTT
caacttgagtacattcatat

SEQ ID NO: 32574 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
tcctgtgtgtattactgggg

SEQ ID NO: 32575 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
tttataatgtgaagcaagct

SEQ ID NO: 32576 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
tacaaactttacaaaaagta

SEQ ID NO: 32577 - DNA, 20 bp, Artificial Sequence
  Description of Artificial Sequence: Synthetic oligonucleotide
  Target: ATXN1; (+) strand; PAM type: NNNNGHTT; PAM sequence: GAGAGATT
aaattttacgaatagtcaca

SEQ ID NO: 32578 - DNA, 20 bp, Artificial Sequence
  Description of Artificial Sequence: Synthetic oligonucleotide
  Target: ATXN1; (+) strand; PAM type: NNNNGHTT; PAM sequence: ATGGGTTT
aatgtcatagctattagcta

SEQ ID NO: 32579 - DNA, 20 bp, Artificial Sequence
  Description of Artificial Sequence: Synthetic oligonucleotide
  Target: ATXN1; (+) strand; PAM type: NNNNGHTT; PAM sequence: TTAGGATT
atagctattagctaatgggt

SEQ ID NO: 32580 - DNA, 20 bp, Artificial Sequence
  Description of Artificial Sequence: Synthetic oligonucleotide
  Target: ATXN1; (+) strand; PAM type: NNNNGHTT; PAM sequence: ATGGGCTT
ggatccaaaggcatgagctc

SEQ ID NO: 32581 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
tggtacagataattgtgatg

SEQ ID NO: 32582 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
tgtacaagtgtgtgacacta

SEQ ID NO: 32583 - DNA, 20 bp, Artificial Sequence
  Description of Artificial Sequence: Synthetic oligonucleotide
  Target: ATXN1; (+) strand; PAM type: NNNNGHTT; PAM sequence: TGGAGATT
gaaaccaatcccacatcaag

SEQ ID NO: 32584 - DNA, 20 bp, Artificial Sequence
  Description of Artificial Sequence: Synthetic oligonucleotide
  Target: ATXN1; (+) strand; PAM type: NNNNGHTT; PAM sequence: GATTGTTT
ccaatcccacatcaagtgga

SEQ ID NO: 32585 - DNA, 20 bp, Artificial Sequence
  Description of Artificial Sequence: Synthetic oligonucleotide
  Target: ATXN1; (+) strand; PAM type: NNNNGHTT; PAM sequence: TGCGGTTT
gtaagactctctaccagagt

SEQ ID NO: 32586 - DNA, 20 bp, Artificial Sequence
  Description of Artificial Sequence: Synthetic oligonucleotide
  Target: ATXN1; (+) strand; PAM type: NNNNGHTT; PAM sequence: GTTTGCTT
gactctctaccagagttgcg

SEQ ID NO: 32587 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
ttctcataggtaaacttatc

SEQ ID NO: 32588 - DNA, 20 bp, Artificial Sequence
  Description of Artificial Sequence: Synthetic oligonucleotide
  Target: ATXN1; (+) strand; PAM type: NNNNGHTT; PAM sequence: AATTGATT
ccctttataacaggtactat

SEQ ID NO: 32589 - DNA, 20 bp, Artificial Sequence
  Description of Artificial Sequence: Synthetic oligonucleotide
  Target: ATXN1; (+) strand; PAM type: NNNNGHTT; PAM sequence: ACGTGTTT
aaaagtcaggatacagatac

SEQ ID NO: 32590 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
acgaacataactaactccat

SEQ ID NO: 32591 - DNA, 20 bp, Artificial Sequence
  Description of Artificial Sequence: Synthetic oligonucleotide
  Target: ATXN1; (+) strand; PAM type: NNNNGHTT; PAM sequence: AAGGGTTT
actaactccatttttgttta

SEQ ID NO: 32592 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgtacttttagaaactaact

SEQ ID NO: 32593 - DNA, 20 bp, Artificial Sequence
  Description of Artificial Sequence: Synthetic oligonucleotide
  Target: ATXN1; (+) strand; PAM type: NNNNGHTT; PAM sequence: TGGAGATT
ctccaaccagcctaaaaaat

SEQ ID NO: 32594 - DNA, 20 bp, Artificial Sequence
  Description of Artificial Sequence: Synthetic oligonucleotide
  Target: ATXN1; (+) strand; PAM type: NNNNGHTT; PAM sequence: GATGGATT
acaaaattattatttcttga

SEQ ID NO: 32595 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
caatctcggctcactgcaac

SEQ ID NO: 32596 - DNA, 20 bp, Artificial Sequence
  Description of Artificial Sequence: Synthetic oligonucleotide
  Target: ATXN1; (+) strand; PAM type: NNNNGHTT; PAM sequence: TGGTGTTT
tttgtattttttagtagaga

SEQ ID NO: 32597 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgccttggcatcccaaagtg

SEQ ID NO: 32598 - DNA, 20 bp, Artificial Sequence
  Description of Artificial Sequence: Synthetic oligonucleotide
  Target: ATXN1; (+) strand; PAM type: NNNNGHTT; PAM sequence: TCTGGCTT
ctcatcatcttctcaatttc

SEQ ID NO: 32599 - DNA, 20 bp, Artificial Sequence
  Description of Artificial Sequence: Synthetic oligonucleotide
  Target: ATXN1; (+) strand; PAM type: NNNNGHTT; PAM sequence: ACCTGCTT
ttctctggctttcccaataa

SEQ ID NO: 32600 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
caccaacctcatctctcgta

SEQ ID NO: 32601 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
gctcactgcaatctctgcct

SEQ ID NO: 32602 - DNA, 20 bp, Artificial Sequence
  Description of Artificial Sequence: Synthetic oligonucleotide
  Target: ATXN1; (+) strand; PAM type: NNNNGHTT; PAM sequence: GAGCGATT
aatctctgcctcctggattc

SEQ ID NO: 32603 - DNA, 20 bp, Artificial Sequence
  Description of Artificial Sequence: Synthetic oligonucleotide
  Target: ATXN1; (+) strand; PAM type: NNNNGHTT; PAM sequence: CAGGGATT
tgcctcagcctcccaagtag

SEQ ID NO: 32604 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttttatatttttagtagaca

SEQ ID NO: 32605 - DNA, 20 bp, Artificial Sequence
  Description of Artificial Sequence: Synthetic oligonucleotide
  Target: ATXN1; (+) strand; PAM type: NNNNGHTT; PAM sequence: CTAGGATT
cgccacagcctcccaaaatg

SEQ ID NO: 32606 - DNA, 20 bp, Artificial Sequence
  Description of Artificial Sequence: Synthetic oligonucleotide
  Target: ATXN1; (+) strand; PAM type: NNNNGHTT; PAM sequence: ATAGGCTT
tgaaatttatgttaacctag

SEQ ID NO: 32607 - DNA, 20 bp, Artificial Sequence
  Description of Artificial Sequence: Synthetic oligonucleotide
  Target: ATXN1; (+) strand; PAM type: NNNNGHTT; PAM sequence: GGGAGATT
atgttaacctagataggctt

SEQ ID NO: 32608 - DNA, 20 bp, Artificial Sequence
  Description of Artificial Sequence: Synthetic oligonucleotide
  Target: ATXN1; (+) strand; PAM type: NNNNGHTT; PAM sequence: AAAGGCTT
gattcttctttaatcacttc

SEQ ID NO: 32609 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
taatcacttcaaaggcttct

SEQ ID NO: 32610 - DNA, 20 bp, Artificial Sequence
  Description of Artificial Sequence: Synthetic oligonucleotide
  Target: ATXN1; (+) strand; PAM type: NNNNGHTT; PAM sequence: CTTTGCTT
tctttttgcctaaattctgc

SEQ ID NO: 32611 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
atgaaagctgaggtgggagc

SEQ ID NO: 32612 - DNA, 20 bp, Artificial Sequence
  Description of Artificial Sequence: Synthetic oligonucleotide
  Target: ATXN1; (+) strand; PAM type: NNNNGHTT; PAM sequence: GATAGCTT
atcattgtaggcacagatcg

SEQ ID NO: 32613 - DNA, 20 bp, Artificial Sequence
  Description of Artificial Sequence: Synthetic oligonucleotide
  Target: ATXN1; (+) strand; PAM type: NNNNGHTT; PAM sequence: GCTAGTTT
ggatagcttgccagcccaat

SEQ ID NO: 32614 - DNA, 20 bp, Artificial Sequence
  Description of Artificial Sequence: Synthetic oligonucleotide
  Target: ATXN1; (+) strand; PAM type: NNNNGHTT; PAM sequence: TAAGGTTT
tgaatgtatgagaagtaaaa

SEQ ID NO: 32615 - DNA, 20 bp, Artificial Sequence
  Description of Artificial Sequence: Synthetic oligonucleotide
  Target: ATXN1; (+) strand; PAM type: NNNNGHTT; PAM sequence: TTAGGTTT
aatctatctttattttataa

SEQ ID NO: 32616 - DNA, 20 bp, Artificial Sequence
  Description of Artificial Sequence: Synthetic oligonucleotide
  Target: ATXN1; (+) strand; PAM type: NNNNGHTT; PAM sequence: AGGGGTTT
ttaatgaagaaatctcactg

SEQ ID NO: 32617 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
agaatatatatcatcaaatc

SEQ ID NO: 32618 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
tgctgtcaatgccagcgggg

SEQ ID NO: 32619 - DNA, 20 bp, Artificial Sequence
  Description of Artificial Sequence: Synthetic oligonucleotide
  Target: ATXN1; (+) strand; PAM type: NNNNGHTT; PAM sequence: GTGTGATT
ttggatgtgaaacagagacg

SEQ ID NO: 32620 - DNA, 20 bp, Artificial Sequence
  Description of Artificial Sequence: Synthetic oligonucleotide
  Target: ATXN1; (+) strand; PAM type: NNNNGHTT; PAM sequence: GATAGCTT
tgggtattctctatgatgct

SEQ ID NO: 32621 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aaactccacctcctgggttc

SEQ ID NO: 32622 - DNA, 20 bp, Artificial Sequence
  Description of Artificial Sequence: Synthetic oligonucleotide
  Target: ATXN1; (+) strand; PAM type: NNNNGHTT; PAM sequence: GTATGTTT
accacacctggctaattttt

SEQ ID NO: 32623 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttttgtatgtttagtagaga

SEQ ID NO: 32624 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgccttggcctcctaaagtg

SEQ ID NO: 32625 - DNA, 20 bp, Artificial Sequence
  Description of Artificial Sequence: Synthetic oligonucleotide
  Target: ATXN1; (+) strand; PAM type: NNNNGHTT; PAM sequence: TCAGGCTT
agggttcctaatgatacatt

SEQ ID NO: 32626 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
taatgatacatttcaggctt

SEQ ID NO: 32627 - DNA, 20 bp, Artificial Sequence
  Description of Artificial Sequence: Synthetic oligonucleotide
  Target: ATXN1; (+) strand; PAM type: NNNNGHTT; PAM sequence: CCTAGTTT
agagtatctattggttaaga

SEQ ID NO: 32628 - DNA, 20 bp, Artificial Sequence
  Description of Artificial Sequence: Synthetic oligonucleotide
  Target: ATXN1; (+) strand; PAM type: NNNNGHTT; PAM sequence: TCTAGTTT
tctatttaaaataacaaccc

SEQ ID NO: 32629 - DNA, 20 bp, Artificial Sequence
  Description of Artificial Sequence: Synthetic oligonucleotide
  Target: ATXN1; (+) strand; PAM type: NNNNGHTT; PAM sequence: CATAGCTT
aataacaaccctctagtttc

SEQ ID NO: 32630 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
catgcaccaccatgtccagc

SEQ ID NO: 32631 - DNA, 20 bp, Artificial Sequence
  Description of Artificial Sequence: Synthetic oligonucleotide
  Target: ATXN1; (+) strand; PAM type: NNNNGHTT; PAM sequence: GCTGGTTT
agccttgctatgttggcctg

SEQ ID NO: 32632 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
tgcctcagcctcccaaagtg

SEQ ID NO: 32633 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
ctgtcagatcagtcgcaagc

SEQ ID NO: 32634 - DNA, 20 bp, Artificial Sequence
  Description of Artificial Sequence: Synthetic oligonucleotide
  Target: ATXN1; (+) strand; PAM type: NNNNGHTT; PAM sequence: AACAGTTT
tgcctgatgatctgaggtgg

SEQ ID NO: 32635 - DNA, 20 bp, Artificial Sequence
  Description of Artificial Sequence: Synthetic oligonucleotide
  Target: ATXN1; (+) strand; PAM type: NNNNGHTT; PAM sequence: GTCTGTTT
ttttatttacttgtatattt

SEQ ID NO: 32636 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
tctgaaggctgaagcaggag

SEQ ID NO: 32637 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
aaaaaaaactgaaagaatag

SEQ ID NO: 32638 - DNA, 20 bp, Artificial Sequence
  Description of Artificial Sequence: Synthetic oligonucleotide
  Target: ATXN1; (+) strand; PAM type: NNNNGHTT; PAM sequence: CAGTGCTT
acctcccccagggagaggag

SEQ ID NO: 32639 - DNA, 20 bp, Artificial Sequence
  Description of Artificial Sequence: Synthetic oligonucleotide
  Target: ATXN1; (+) strand; PAM type: NNNNGHTT; PAM sequence: TGTGGCTT
gagcagtgctttctccaggg

SEQ ID NO: 32640 - DNA, 20 bp, Artificial Sequence
  Description of Artificial Sequence: Synthetic oligonucleotide
  Target: ATXN1; (+) strand; PAM type: NNNNGHTT; PAM sequence: GGCAGCTT
tgtggctttaccgcctaaca

SEQ ID NO: 32641 - DNA, 20 bp, Artificial Sequence
  Description of Artificial Sequence: Synthetic oligonucleotide
  Target: ATXN1; (+) strand; PAM type: NNNNGHTT; PAM sequence: TCATGATT
cttgtcagatgctgaggtcg

SEQ ID NO: 32642 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
gggttccacacattttccag

SEQ ID NO: 32643 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
cacacattttccagaatggt

SEQ ID NO: 32644 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
tttttcatccagtaaatata

SEQ ID NO: 32645 - DNA, 20 bp, Artificial Sequence
  Description of Artificial Sequence: Synthetic oligonucleotide
  Target: ATXN1; (+) strand; PAM type: NNNNGHTT; PAM sequence: TCTTGATT
gctagagtgtagtggtgcca

SEQ ID NO: 32646 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcccaagtag

SEQ ID NO: 32647 - DNA, 20 bp, Artificial Sequence
  Description of Artificial Sequence: Synthetic oligonucleotide
  Target: ATXN1; (+) strand; PAM type: NNNNGHTT; PAM sequence: ACGGGTTT
tttttttgtatttagtagag

SEQ ID NO: 32648 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacctcggcctcccaaagtg

SEQ ID NO: 32649 - DNA, 20 bp, Artificial Sequence
  Description of Artificial Sequence: Synthetic oligonucleotide
  Target: ATXN1; (+) strand; PAM type: NNNNGHTT; PAM sequence: GTAAGCTT
gggatggcctttatactttt

SEQ ID NO: 32650 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
gatgccctgtcgccagcacc

SEQ ID NO: 32651 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
ccttcctaatctgactaatg

SEQ ID NO: 32652 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
tgcacatacacgcatattta

SEQ ID NO: 32653 - DNA, 20 bp, Artificial Sequence
  Description of Artificial Sequence: Synthetic oligonucleotide
  Target: ATXN1; (+) strand; PAM type: NNNNGHTT; PAM sequence: GTTTGATT
catacacgcatatttatgct

SEQ ID NO: 32654 - DNA, 20 bp, Artificial Sequence
  Description of Artificial Sequence: Synthetic oligonucleotide
  Target: ATXN1; (+) strand; PAM type: NNNNGHTT; PAM sequence: CTTAGATT
gtttgattgtatatttcaat

SEQ ID NO: 32655 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
tagaaagaaaacaaaacgtc

SEQ ID NO: 32656 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
cccatttccttcacaagagt

SEQ ID NO: 32657 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
tttcacaaattgcgaagggc

SEQ ID NO: 32658 - DNA, 20 bp, Artificial Sequence
  Description of Artificial Sequence: Synthetic oligonucleotide
  Target: ATXN1; (+) strand; PAM type: NNNNGHTT; PAM sequence: CTAGGTTT
gcaatgaattctctcataag

SEQ ID NO: 32659 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
gctaggtttcagtaagtatg

SEQ ID NO: 32660 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
tctgcaagtgaaattctcag

SEQ ID NO: 32661 - DNA, 20 bp, Artificial Sequence
  Description of Artificial Sequence: Synthetic oligonucleotide
  Target: ATXN1; (+) strand; PAM type: NNNNGHTT; PAM sequence: GTCTGCTT
ttacctgtagagaaaggccg

SEQ ID NO: 32662 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
agcgagagacccatttactg

SEQ ID NO: 32663 - DNA, 20 bp, Artificial Sequence
  Description of Artificial Sequence: Synthetic oligonucleotide
  Target: ATXN1; (+) strand; PAM type: NNNNGHTT; PAM sequence: AAACGCTT
atcattaataaaaacagtca

SEQ ID NO: 32664 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
cctgactcagtccttggtgg

SEQ ID NO: 32665 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
cacaaatcccacattaaaag

SEQ ID NO: 32666 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
ttcctagggaggctgaagtg

SEQ ID NO: 32667 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
tagggaggctgaagtgggag

SEQ ID NO: 32668 - DNA, 20 bp, Artificial Sequence
  Description of Artificial Sequence: Synthetic oligonucleotide
  Target: ATXN1; (+) strand; PAM type: NNNNGHTT; PAM sequence: GGATGATT
atgtgaaaaggcgacatacc

SEQ ID NO: 32669 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
taaaatgatcagtgggtgcc

SEQ ID NO: 32670 - DNA, 20 bp, Artificial Sequence
  Description of Artificial Sequence: Synthetic oligonucleotide
  Target: ATXN1; (+) strand; PAM type: NNNNGHTT; PAM sequence: AAGGGATT
gggacaaatagttgatgcat

SEQ ID NO: 32671 - DNA, 20 bp, Artificial Sequence
  Description of Artificial Sequence: Synthetic oligonucleotide
  Target: ATXN1; (+) strand; PAM type: NNNNGHTT; PAM sequence: GCAAGATT
aaccaatctatcacaccaat

SEQ ID NO: 32672 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
tctacttgctgtacacctaa

SEQ ID NO: 32673 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
ttgggggcacatatagcaca

SEQ ID NO: 32674 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
caaagacccacaaacaaaaa

SEQ ID NO: 32675 - DNA, 20 bp, Artificial Sequence
  Description of Artificial Sequence: Synthetic oligonucleotide
  Target: ATXN1; (+) strand; PAM type: NNNNGHTT; PAM sequence: CATAGTTT
caaacaaaaatgtggtttga

SEQ ID NO: 32676 - DNA, 20 bp, Artificial Sequence
  Description of Artificial Sequence: Synthetic oligonucleotide
  Target: ATXN1; (+) strand; PAM type: NNNNGHTT; PAM sequence: TTAGGATT
actatctattttttgataca

SEQ ID NO: 32677 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
cagaagaggagcctgggagc

SEQ ID NO: 32678 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
atccagttcatactcagaaa

SEQ ID NO: 32679 - DNA, 20 bp, Artificial Sequence
  Description of Artificial Sequence: Synthetic oligonucleotide
  Target: ATXN1; (+) strand; PAM type: NNNNGHTT; PAM sequence: GCGGGATT
ggtgctcgcctcggccactc

SEQ ID NO: 32680 - DNA, 20 bp, Artificial Sequence
  Description of Artificial Sequence: Synthetic oligonucleotide
  Target: ATXN1; (+) strand; PAM type: NNNNGHTT; PAM sequence: CGAGGATT
ccactcgcgggattccaccc

SEQ ID NO: 32681 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
aggattacaggcagggtaaa

SEQ ID NO: 32682 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
ctctttttagaacacgaggc

SEQ ID NO: 32683 - DNA, 20 bp, Artificial Sequence
  Description of Artificial Sequence: Synthetic oligonucleotide
  Target: ATXN1; (+) strand; PAM type: NNNNGHTT; PAM sequence: AGTGGATT
ctcaaacttggaggatatta

SEQ ID NO: 32684 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
ttggcagtgaggcccaaggg

SEQ ID NO: 32685 - DNA, 20 bp, Artificial Sequence
  Description of Artificial Sequence: Synthetic oligonucleotide
  Target: ATXN1; (+) strand; PAM type: NNNNGHTT; PAM sequence: GGAGGCTT
caccctccactgaagaggaa

SEQ ID NO: 32686 - DNA, 20 bp, Artificial Sequence
  Description of Artificial Sequence: Synthetic oligonucleotide
  Target: ATXN1; (+) strand; PAM type: NNNNGHTT; PAM sequence: AGACGCTT
tgggggcctgggggatgcat

SEQ ID NO: 32687 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
catccccaaactaaacaccc

SEQ ID NO: 32688 - DNA, 20 bp, Artificial Sequence
  Description of Artificial Sequence: Synthetic oligonucleotide
  Target: ATXN1; (+) strand; PAM type: NNNNGHTT; PAM sequence: CATGGCTT
cacccctcagttttatatgc

SEQ ID NO: 32689 - DNA, 20 bp, Artificial Sequence
  Description of Artificial Sequence: Synthetic oligonucleotide
  Target: ATXN1; (+) strand; PAM type: NNNNGHTT; PAM sequence: TGCCGCTT
tagttcccatgaggtctgtg

SEQ ID NO: 32690 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
atgttcatcttaatgctctt

SEQ ID NO: 32691 - DNA, 20 bp, Artificial Sequence
  Description of Artificial Sequence: Synthetic oligonucleotide
  Target: ATXN1; (+) strand; PAM type: NNNNGHTT; PAM sequence: AAGAGATT
ttaaaaaacggaaccctctc

SEQ ID NO: 32692 - DNA, 20 bp, Artificial Sequence
  Description of Artificial Sequence: Synthetic oligonucleotide
  Target: ATXN1; (+) strand; PAM type: NNNNGHTT; PAM sequence: GATCGCTT
ttgggagaccgaggtgggtg

SEQ ID NO: 32693 - DNA, 20 bp, Artificial Sequence
  Description of Artificial Sequence: Synthetic oligonucleotide
  Target: ATXN1; (+) strand; PAM type: NNNNGHTT; PAM sequence: CCTGGTTT
agaaaaacaaaactcatttg

SEQ ID NO: 32694 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
gtcaccaccatactatatca

SEQ ID NO: 32695 - DNA, 20 bp, Artificial Sequence
  Description of Artificial Sequence: Synthetic oligonucleotide
  Target: ATXN1; (+) strand; PAM type: NNNNGHTT; PAM sequence: GCAGGATT
atcctcaagagtctgttcat

SEQ ID NO: 32696 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
ctgcctagagtcacaatgcc

SEQ ID NO: 32697 - DNA, 20 bp, Artificial Sequence
  Description of Artificial Sequence: Synthetic oligonucleotide
  Target: ATXN1; (+) strand; PAM type: NNNNGHTT; PAM sequence: TTGTGATT
cacaacttccccaatcaaat

SEQ ID NO: 32698 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
ttccccaatcaaatttgtga

SEQ ID NO: 32699 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
ctaaccagttgagaagacca

SEQ ID NO: 32700 - DNA, 20 bp, Artificial Sequence
  Description of Artificial Sequence: Synthetic oligonucleotide
  Target: ATXN1; (+) strand; PAM type: NNNNGHTT; PAM sequence: AGCCGATT
attttagctgtgatgatgtc

SEQ ID NO: 32701 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
ggttgcgtcaggccttgcac

SEQ ID NO: 32702 - DNA, 20 bp, Artificial Sequence
  Description of Artificial Sequence: Synthetic oligonucleotide
  Target: ATXN1; (+) strand; PAM type: NNNNGHTT; PAM sequence: GAGAGATT
ctgcaccctggctgtcagta

SEQ ID NO: 32703 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
tcatttaatcattaattttg

SEQ ID NO: 32704 - DNA, 20 bp, Artificial Sequence
  Description of Artificial Sequence: Synthetic oligonucleotide
  Target: ATXN1; (+) strand; PAM type: NNNNGHTT; PAM sequence: CCCAGCTT
cagtggctcacgcctacaat

SEQ ID NO: 32705 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
aaaaaaaaaaaatagaagag

SEQ ID NO: 32706 - DNA, 20 bp, Artificial Sequence
  Description of Artificial Sequence: Synthetic oligonucleotide
  Target: ATXN1; (+) strand; PAM type: NNNNGHTT; PAM sequence: TAAGGATT
ctctgttcacaaaaatgtgt

SEQ ID NO: 32707 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
gaaaagcaatgactcttcac

SEQ ID NO: 32708 - DNA, 20 bp, Artificial Sequence
  Description of Artificial Sequence: Synthetic oligonucleotide
  Target: ATXN1; (+) strand; PAM type: NNNNGHTT; PAM sequence: TCCTGATT
tatgccatttattttaaaaa

SEQ ID NO: 32709 - DNA, 20 bp, Artificial Sequence
  Description of Artificial Sequence: Synthetic oligonucleotide
  Target: ATXN1; (+) strand; PAM type: NNNNGHTT; PAM sequence: CCCGGCTT
agctctcggcaatgcagggc

SEQ ID NO: 32710 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
attcacgagtggttctggaa

SEQ ID NO: 32711 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
gggactcgtgtctgtaatct

SEQ ID NO: 32712 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
ttgggaggccgaggtggaag

SEQ ID NO: 32713 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
ggaaggactgcttggagccc

SEQ ID NO: 32714 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
gcaagaccccatctctacta

SEQ ID NO: 32715 - DNA, 20 bp, Artificial Sequence
  Description of Artificial Sequence: Synthetic oligonucleotide
  Target: ATXN1; (+) strand; PAM type: NNNNGHTT; PAM sequence: CTATGATT
gaggtcaaggccacagtgag

SEQ ID NO: 32716 - DNA, 20 bp, Artificial Sequence
  Description of Artificial Sequence: Synthetic oligonucleotide
  Target: ATXN1; (+) strand; PAM type: NNNNGHTT; PAM sequence: ATTAGTTT
caaaacaattcaaaccatta

SEQ ID NO: 32717 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
taattagtttatcttttttt

SEQ ID NO: 32718 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
aaggaggctctgtcccattt

SEQ ID NO: 32719 - DNA, 20 bp, Artificial Sequence
  Description of Artificial Sequence: Synthetic oligonucleotide
  Target: ATXN1; (+) strand; PAM type: NNNNGHTT; PAM sequence: GGTAGATT
gatctaagaacctggaaaag

SEQ ID NO: 32720 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
acctgggacagccctgactt

SEQ ID NO: 32721 - DNA, 20 bp, Artificial Sequence
  Description of Artificial Sequence: Synthetic oligonucleotide
  Target: ATXN1; (+) strand; PAM type: NNNNGHTT; PAM sequence: CCACGCTT
gacttctcagattgtattaa

SEQ ID NO: 32722 - DNA, 20 bp, Artificial Sequence
  Description of Artificial Sequence: Synthetic oligonucleotide
  Target: ATXN1; (+) strand; PAM type: NNNNGHTT; PAM sequence: TGATGCTT
ttaaccacgcttttattttc

SEQ ID NO: 32723 - DNA, 20 bp, Artificial Sequence
  Description of Artificial Sequence: Synthetic oligonucleotide
  Target: ATXN1; (+) strand; PAM type: NNNNGHTT; PAM sequence: CTAGGATT
tcccagaggtatagtctctc

SEQ ID NO: 32724 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
cacacttagggctgccttcc

SEQ ID NO: 32725 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tacctcagcctctggagtag

SEQ ID NO: 32726 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
ttttgtatttttagtagaga

SEQ ID NO: 32727 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgcctcagcctcccaaagtg

SEQ ID NO: 32728 - DNA, 20 bp, Artificial Sequence
  Description of Artificial Sequence: Synthetic oligonucleotide
  Target: ATXN1; (+) strand; PAM type: NNNNGHTT; PAM sequence: ACCCGTTT
tccactctaaccaatcctaa

SEQ ID NO: 32729 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
catgaaaccacaataaaggc

SEQ ID NO: 32730 - DNA, 20 bp, Artificial Sequence
  Description of Artificial Sequence: Synthetic oligonucleotide
  Target: ATXN1; (+) strand; PAM type: NNNNGHTT; PAM sequence: TGGGGCTT
cctccacctcctgacccacc

SEQ ID NO: 32731 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
accgggccttgctatgttgc

SEQ ID NO: 32732 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
aacatggatgttgcaatggg

SEQ ID NO: 32733 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
tggatgttgcaatgggatat

SEQ ID NO: 32734 - DNA, 20 bp, Artificial Sequence
  Description of Artificial Sequence: Synthetic oligonucleotide
  Target: ATXN1; (+) strand; PAM type: NNNNGHTT; PAM sequence: CAGCGTTT
tagaaggacctgaagtccag

SEQ ID NO: 32735 - DNA, 20 bp, Artificial Sequence
  Description of Artificial Sequence: Synthetic oligonucleotide
  Target: ATXN1; (+) strand; PAM type: NNNNGHTT; PAM sequence: GTGAGTTT
ttcaaaaaataactagagtg

SEQ ID NO: 32736 - DNA, 20 bp, Artificial Sequence
  Description of Artificial Sequence: Synthetic oligonucleotide
  Target: ATXN1; (+) strand; PAM type: NNNNGHTT; PAM sequence: TCTGGATT
aataactagagtggtgagtt

SEQ ID NO: 32737 - DNA, 20 bp, Artificial Sequence
  Description of Artificial Sequence: Synthetic oligonucleotide
  Target: ATXN1; (+) strand; PAM type: NNNNGHTT; PAM sequence: TGGGGCTT
cagcagagatcacggggaaa

SEQ ID NO: 32738 - DNA, 20 bp, Artificial Sequence
  Description of Artificial Sequence: Synthetic oligonucleotide
  Target: ATXN1; (+) strand; PAM type: NNNNGHTT; PAM sequence: CGTTGCTT
gctggagtcgatcttcaggt

SEQ ID NO: 32739 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
tctgcactctggatgaaatc

SEQ ID NO: 32740 - DNA, 20 bp, Artificial Sequence
  Description of Artificial Sequence: Synthetic oligonucleotide
  Target: ATXN1; (+) strand; PAM type: NNNNGHTT; PAM sequence: CGACGCTT
actatggccggggctgcccc

SEQ ID NO: 32741 - DNA, 20 bp, Artificial Sequence
  Description of Artificial Sequence: Synthetic oligonucleotide
  Target: ATXN1; (+) strand; PAM type: NNNNGHTT; PAM sequence: AGGTGATT
ctggggcaggctgccggcgt

SEQ ID NO: 32742 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ggcaggctgccggcgtaggt

SEQ ID NO: 32743 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
agagcgcgtaggaccggtgg

SEQ ID NO: 32744 - DNA, 20 bp, Artificial Sequence
  Description of Artificial Sequence: Synthetic oligonucleotide
  Target: ATXN1; (+) strand; PAM type: NNNNGHTT; PAM sequence: GGAGGCTT
ttgtcgttgagggtagaagg

SEQ ID NO: 32745 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
gcctgctgcagccggctgct

SEQ ID NO: 32746 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
gagtagtccagccctgtgga

SEQ ID NO: 32747 - DNA, 20 bp, Artificial Sequence
  Description of Artificial Sequence: Synthetic oligonucleotide
  Target: ATXN1; (+) strand; PAM type: NNNNGHTT; PAM sequence: TCGCGCTT
accggctggtggcggggatc

SEQ ID NO: 32748 - DNA, 20 bp, Artificial Sequence
  Description of Artificial Sequence: Synthetic oligonucleotide
  Target: ATXN1; (+) strand; PAM type: NNNNGHTT; PAM sequence: GTTGGATT
cattcgttgctccgctcttg

SEQ ID NO: 32749 - DNA, 20 bp, Artificial Sequence
  Description of Artificial Sequence: Synthetic oligonucleotide
  Target: ATXN1; (+) strand; PAM type: NNNNGHTT; PAM sequence: GACTGTTT
cgccgtcccccctccacggt

SEQ ID NO: 32750 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
ctgtttcactgtctggatgg

SEQ ID NO: 32751 - DNA, 20 bp, Artificial Sequence
  Description of Artificial Sequence: Synthetic oligonucleotide
  Target: ATXN1; (+) strand; PAM type: NNNNGHTT; PAM sequence: ATTTGATT
tctgataaacggaaagtcac

SEQ ID NO: 32752 - DNA, 20 bp, Artificial Sequence
  Description of Artificial Sequence: Synthetic oligonucleotide
  Target: ATXN1; (+) strand; PAM type: NNNNGHTT; PAM sequence: GCAAGATT
ccggggaaagaacatctttg

SEQ ID NO: 32753 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
ggcaggcagatcacgaggtc

SEQ ID NO: 32754 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
ttgagaggctgaggcaggag

SEQ ID NO: 32755 - DNA, 20 bp, Artificial Sequence
  Description of Artificial Sequence: Synthetic oligonucleotide
  Target: ATXN1; (+) strand; PAM type: NNNNGHTT; PAM sequence: CCGAGATT
gaggcagaggttgcagtgag

SEQ ID NO: 32756 - DNA, 20 bp, Artificial Sequence
  Description of Artificial Sequence: Synthetic oligonucleotide
  Target: ATXN1; (+) strand; PAM type: NNNNGHTT; PAM sequence: GGAAGATT
tggcagctgcacattataaa

SEQ ID NO: 32757 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
gatgttctcaataccctctc

SEQ ID NO: 32758 - DNA, 20 bp, Artificial Sequence
  Description of Artificial Sequence: Synthetic oligonucleotide
  Target: ATXN1; (+) strand; PAM type: NNNNGHTT; PAM sequence: ACTCGATT
aagtccagaacagtccttgc

SEQ ID NO: 32759 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
tctgccagagccactactct

SEQ ID NO: 32760 - DNA, 20 bp, Artificial Sequence
  Description of Artificial Sequence: Synthetic oligonucleotide
  Target: ATXN1; (+) strand; PAM type: NNNNGHTT; PAM sequence: CTACGATT
gctctgggtccacactggac

SEQ ID NO: 32761 - DNA, 20 bp, Artificial Sequence
  Description of Artificial Sequence: Synthetic oligonucleotide
  Target: ATXN1; (+) strand; PAM type: NNNNGHTT; PAM sequence: GCAAGTTT
cagaaataatcctgttctct

SEQ ID NO: 32762 - DNA, 20 bp, Artificial Sequence
  Description of Artificial Sequence: Synthetic oligonucleotide
  Target: ATXN1; (+) strand; PAM type: NNNNGHTT; PAM sequence: ATTTGATT
gtgagactgttaaaaaccga

SEQ ID NO: 32763 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
aaaaatagggctagtgcact

SEQ ID NO: 32764 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
gaatgttttctcagtgggtt

SEQ ID NO: 32765 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
ttttctcagtgggttacatg

SEQ ID NO: 32766 - DNA, 20 bp, Artificial Sequence
  Description of Artificial Sequence: Synthetic oligonucleotide
  Target: ATXN1; (+) strand; PAM type: NNNNGHTT; PAM sequence: ATGTGATT
cccaggctagcaagcagcgg

SEQ ID NO: 32767 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ggctagcaagcagcggatgt

SEQ ID NO: 32768 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
ggtatgcacagtgcaacatg

SEQ ID NO: 32769 - DNA, 20 bp, Artificial Sequence
  Description of Artificial Sequence: Synthetic oligonucleotide
  Target: ATXN1; (+) strand; PAM type: NNNNGHTT; PAM sequence: GTGGGATT
atgctgtgattctgagagct

SEQ ID NO: 32770 - DNA, 20 bp, Artificial Sequence
  Description of Artificial Sequence: Synthetic oligonucleotide
  Target: ATXN1; (+) strand; PAM type: NNNNGHTT; PAM sequence: TTGGGCTT
tgattctgagagctgtggga

SEQ ID NO: 32771 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
gctttgggaattccacaccc

SEQ ID NO: 32772 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
tccagaccctcttttcaatg

SEQ ID NO: 32773 - DNA, 20 bp, Artificial Sequence
  Description of Artificial Sequence: Synthetic oligonucleotide
  Target: ATXN1; (+) strand; PAM type: NNNNGHTT; PAM sequence: CTAGGATT
ttccttggcctcccaaagtg

SEQ ID NO: 32774 - DNA, 20 bp, Artificial Sequence
  Description of Artificial Sequence: Synthetic oligonucleotide
  Target: ATXN1; (+) strand; PAM type: NNNNGHTT; PAM sequence: ATCCGATT
gccactgtgtgtagccaatg

SEQ ID NO: 32775 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
taactattttttagaggggg

SEQ ID NO: 32776 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
tttttttttttttgaaaagg

SEQ ID NO: 32777 - DNA, 20 bp, Artificial Sequence
  Description of Artificial Sequence: Synthetic oligonucleotide
  Target: ATXN1; (+) strand; PAM type: NNNNGHTT; PAM sequence: CTCGGCTT
ctgaagtgcagtggcgtgat

SEQ ID NO: 32778 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtactttttgtagagg

SEQ ID NO: 32779 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
acccacttggcctcccggtg

SEQ ID NO: 32780 - DNA, 20 bp, Artificial Sequence
  Description of Artificial Sequence: Synthetic oligonucleotide
  Target: ATXN1; (+) strand; PAM type: NNNNGHTT; PAM sequence: GCCAGCTT
tacaggcatgagccactgca

SEQ ID NO: 32781 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
tgcagccagcttggaagggg

SEQ ID NO: 32782 - DNA, 20 bp, Artificial Sequence
  Description of Artificial Sequence: Synthetic oligonucleotide
  Target: ATXN1; (+) strand; PAM type: NNNNGHTT; PAM sequence: ATTGGTTT
gcaatgatttaatggccctt

SEQ ID NO: 32783 - DNA, 20 bp, Artificial Sequence
  Description of Artificial Sequence: Synthetic oligonucleotide
  Target: ATXN1; (+) strand; PAM type: NNNNGHTT; PAM sequence: TAATGATT
aacagaaagttctcaatcct

SEQ ID NO: 32784 - DNA, 20 bp, Artificial Sequence
  Description of Artificial Sequence: Synthetic oligonucleotide
  Target: ATXN1; (+) strand; PAM type: NNNNGHTT; PAM sequence: GCAGGTTT
gatcagatatctaggaaggt

SEQ ID NO: 32785 - DNA, 20 bp, Artificial Sequence
  Description of Artificial Sequence: Synthetic oligonucleotide
  Target: ATXN1; (+) strand; PAM type: NNNNGHTT; PAM sequence: AGGCGCTT
aatttctcatatgacaagag

SEQ ID NO: 32786 - DNA, 20 bp, Artificial Sequence
  Description of Artificial Sequence: Synthetic oligonucleotide
  Target: ATXN1; (+) strand; PAM type: NNNNGHTT; PAM sequence: AGGTGTTT
cttatttactctcgcaaccc

SEQ ID NO: 32787 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aacctccgcctcccgggttc

SEQ ID NO: 32788 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcctgagtag

SEQ ID NO: 32789 - DNA, 20 bp, Artificial Sequence
  Description of Artificial Sequence: Synthetic oligonucleotide
  Target: ATXN1; (+) strand; PAM type: NNNNGHTT; PAM sequence: CGGAGTTT
ttttgtatttttagtagagg

SEQ ID NO: 32790 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
agcctctacctcccaaagtg

SEQ ID NO: 32791 - DNA, 20 bp, Artificial Sequence
  Description of Artificial Sequence: Synthetic oligonucleotide
  Target: ATXN1; (+) strand; PAM type: NNNNGHTT; PAM sequence: TAGGGTTT
gccactgcgccctgcccacc

SEQ ID NO: 32792 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
actgatccaataaaacccca

SEQ ID NO: 32793 - DNA, 20 bp, Artificial Sequence
  Description of Artificial Sequence: Synthetic oligonucleotide
  Target: ATXN1; (+) strand; PAM type: NNNNGHTT; PAM sequence: GCCAGCTT
tgaaggtacttctttaggaa

SEQ ID NO: 32794 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
gacttggttctcagtagtgc

SEQ ID NO: 32795 - DNA, 20 bp, Artificial Sequence
  Description of Artificial Sequence: Synthetic oligonucleotide
  Target: ATXN1; (+) strand; PAM type: NNNNGHTT; PAM sequence: TACTGTTT
gtagtgctcaggtttaatta

SEQ ID NO: 32796 - DNA, 20 bp, Artificial Sequence
  Description of Artificial Sequence: Synthetic oligonucleotide
  Target: ATXN1; (+) strand; PAM type: NNNNGHTT; PAM sequence: ATCGGCTT
atactgtttatttgagagac

SEQ ID NO: 32797 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
cactggactggtcttctgcg

SEQ ID NO: 32798 - DNA, 20 bp, Artificial Sequence
  Description of Artificial Sequence: Synthetic oligonucleotide
  Target: ATXN1; (+) strand; PAM type: NNNNGHTT; PAM sequence: CAGAGATT
ttgataaacagcatcttttc

SEQ ID NO: 32799 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
ccaatgagaaatcaaggaca

SEQ ID NO: 32800 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
cgagctggggccaaaccgat

SEQ ID NO: 32801 - DNA, 20 bp, Artificial Sequence
  Description of Artificial Sequence: Synthetic oligonucleotide
  Target: ATXN1; (+) strand; PAM type: NNNNGHTT; PAM sequence: GTAAGCTT
gtgtcccttctctgggcccc

SEQ ID NO: 32802 - DNA, 20 bp, Artificial Sequence
  Description of Artificial Sequence: Synthetic oligonucleotide
  Target: ATXN1; (+) strand; PAM type: NNNNGHTT; PAM sequence: TAGAGATT
gataaggggaaacccacggg

SEQ ID NO: 32803 - DNA, 20 bp, Artificial Sequence
  Description of Artificial Sequence: Synthetic oligonucleotide
  Target: ATXN1; (+) strand; PAM type: NNNNGHTT; PAM sequence: AGTAGATT
gtaacttatgaaggtggaaa

SEQ ID NO: 32804 - DNA, 20 bp, Artificial Sequence
  Description of Artificial Sequence: Synthetic oligonucleotide
  Target: ATXN1; (+) strand; PAM type: NNNNGHTT; PAM sequence: GTGGGATT
agaaaaaagaaaaaaggaga

SEQ ID NO: 32805 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
gccctcccaggggacccccg

SEQ ID NO: 32806 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
tggaagcacctgccacaaca

SEQ ID NO: 32807 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
agagccacatatgcagatcg

SEQ ID NO: 32808 - DNA, 20 bp, Artificial Sequence
  Description of Artificial Sequence: Synthetic oligonucleotide
  Target: ATXN1; (+) strand; PAM type: NNNNGHTT; PAM sequence: TAGAGTTT
tgaatcaagacaaatgtatt

SEQ ID NO: 32809 - DNA, 20 bp, Artificial Sequence
  Description of Artificial Sequence: Synthetic oligonucleotide
  Target: ATXN1; (+) strand; PAM type: NNNNGHTT; PAM sequence: CATGGTTT
tgtatttagagtttgctacc

SEQ ID NO: 32810 - DNA, 20 bp, Artificial Sequence
  Description of Artificial Sequence: Synthetic oligonucleotide
  Target: ATXN1; (+) strand; PAM type: NNNNGHTT; PAM sequence: AGCCGCTT
ttctgaatacattcatctta

SEQ ID NO: 32811 - DNA, 20 bp, Artificial Sequence
  Description of Artificial Sequence: Synthetic oligonucleotide
  Target: ATXN1; (+) strand; PAM type: NNNNGHTT; PAM sequence: TAAGGCTT
ctaaatttagcccagtggta

SEQ ID NO: 32812 - DNA, 20 bp, Artificial Sequence
  Description of Artificial Sequence: Synthetic oligonucleotide
  Target: ATXN1; (+) strand; PAM type: NNNNGHTT; PAM sequence: GCAAGTTT
ccgtgacatcagcatcctct

SEQ ID NO: 32813 - DNA, 20 bp, Artificial Sequence
  Description of Artificial Sequence: Synthetic oligonucleotide
  Target: ATXN1; (+) strand; PAM type: NNNNGHTT; PAM sequence: AGATGATT
tgcattttaacaagatatcc

SEQ ID NO: 32814 - DNA, 20 bp, Artificial Sequence
  Description of Artificial Sequence: Synthetic oligonucleotide
  Target: ATXN1; (+) strand; PAM type: NNNNGHTT; PAM sequence: TAAGGTTT
ccagatgattctatgcacag

SEQ ID NO: 32815 - DNA, 20 bp, Artificial Sequence
  Description of Artificial Sequence: Synthetic oligonucleotide
  Target: ATXN1; (+) strand; PAM type: NNNNGHTT; PAM sequence: ATCCGATT
tttgagaaaccctagcagct

SEQ ID NO: 32816 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
ctaatatttaggtgatgctc

SEQ ID NO: 32817 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
atacggctgcaaataacaaa

SEQ ID NO: 32818 - DNA, 20 bp, Artificial Sequence
  Description of Artificial Sequence: Synthetic oligonucleotide
  Target: ATXN1; (+) strand; PAM type: NNNNGHTT; PAM sequence: CATGGATT
gagaaattttttgctattac

SEQ ID NO: 32819 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
ttgctattaccatggattca

SEQ ID NO: 32820 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
tgggaagtgataggaaaatg

SEQ ID NO: 32821 - DNA, 20 bp, Artificial Sequence
  Description of Artificial Sequence: Synthetic oligonucleotide
  Target: ATXN1; (+) strand; PAM type: NNNNGHTT; PAM sequence: GGTTGCTT
aaacctagggcaagaaaatg

SEQ ID NO: 32822 - DNA, 20 bp, Artificial Sequence
  Description of Artificial Sequence: Synthetic oligonucleotide
  Target: ATXN1; (+) strand; PAM type: NNNNGHTT; PAM sequence: CTGTGCTT
cttttcctacacccccaatc

SEQ ID NO: 32823 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
acacccccaatcctgtgctt

SEQ ID NO: 32824 - DNA, 20 bp, Artificial Sequence
  Description of Artificial Sequence: Synthetic oligonucleotide
  Target: ATXN1; (+) strand; PAM type: NNNNGHTT; PAM sequence: CACGGTTT
atatctatggacaaacaggg

SEQ ID NO: 32825 - DNA, 20 bp, Artificial Sequence
  Description of Artificial Sequence: Synthetic oligonucleotide
  Target: ATXN1; (+) strand; PAM type: NNNNGHTT; PAM sequence: TTCAGCTT
atggacaaacagggcacggt

SEQ ID NO: 32826 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
agaagaggaagagcaggctg

SEQ ID NO: 32827 - DNA, 20 bp, Artificial Sequence
  Description of Artificial Sequence: Synthetic oligonucleotide
  Target: ATXN1; (+) strand; PAM type: NNNNGHTT; PAM sequence: CAAGGATT
cagaggttacttgggcatgt

SEQ ID NO: 32828 - DNA, 20 bp, Artificial Sequence
  Description of Artificial Sequence: Synthetic oligonucleotide
  Target: ATXN1; (+) strand; PAM type: NNNNGHTT; PAM sequence: TCCAGCTT
tgctgactcaccaatctcct

SEQ ID NO: 32829 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
taaaaacaggtccaaacccg

SEQ ID NO: 32830 - DNA, 20 bp, Artificial Sequence
  Description of Artificial Sequence: Synthetic oligonucleotide
  Target: ATXN1; (+) strand; PAM type: NNNNGHTT; PAM sequence: GGTGGATT
gagtatctagaatggagaaa

SEQ ID NO: 32831 - DNA, 20 bp, Artificial Sequence
  Description of Artificial Sequence: Synthetic oligonucleotide
  Target: ATXN1; (+) strand; PAM type: NNNNGHTT; PAM sequence: TTCCGTTT
attcattcatcaaacactca

SEQ ID NO: 32832 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
tgttctattcaatactaata

SEQ ID NO: 32833 - DNA, 20 bp, Artificial Sequence
  Description of Artificial Sequence: Synthetic oligonucleotide
  Target: ATXN1; (+) strand; PAM type: NNNNGHTT; PAM sequence: ATAAGATT
agaagggatatatgttgcga

SEQ ID NO: 32834 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
aataaatgtaaatgcctgcc

SEQ ID NO: 32835 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
tactagcagggttgaagaga

SEQ ID NO: 32836 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
ttgaagagatctggtttaat

SEQ ID NO: 32837 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
ggtttcaatgaaagagccca

SEQ ID NO: 32838 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
aatgaaagagcccagaaagt

SEQ ID NO: 32839 - DNA, 20 bp, Artificial Sequence
  Description of Artificial Sequence: Synthetic oligonucleotide
  Target: ATXN1; (+) strand; PAM type: NNNNGHTT; PAM sequence: GGTGGTTT
aaaaaaaattagctaggcat

SEQ ID NO: 32840 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
ctacccaggaggctaaggca

SEQ ID NO: 32841 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ccaggaggctaaggcaggag

SEQ ID NO: 32842 - DNA, 20 bp, Artificial Sequence
  Description of Artificial Sequence: Synthetic oligonucleotide
  Target: ATXN1; (+) strand; PAM type: NNNNGHTT; PAM sequence: CCATGATT
gaggttgaggctgcagtgag

SEQ ID NO: 32843 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
ccattaggaacattctgaga

SEQ ID NO: 32844 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
ttccactctgtgtcaaggtg

SEQ ID NO: 32845 - DNA, 20 bp, Artificial Sequence
  Description of Artificial Sequence: Synthetic oligonucleotide
  Target: ATXN1; (+) strand; PAM type: NNNNGHTT; PAM sequence: TGGAGCTT
cttccatgtctatctaagcg

SEQ ID NO: 32846 - DNA, 20 bp, Artificial Sequence
  Description of Artificial Sequence: Synthetic oligonucleotide
  Target: ATXN1; (+) strand; PAM type: NNNNGHTT; PAM sequence: TCGGGTTT
agagcctcgccccaacgcgc

SEQ ID NO: 32847 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
atgcccactcagaacctggg

SEQ ID NO: 32848 - DNA, 20 bp, Artificial Sequence
  Description of Artificial Sequence: Synthetic oligonucleotide
  Target: ATXN1; (+) strand; PAM type: NNNNGHTT; PAM sequence: TATGGATT
agggtctttgcagatgtaat

SEQ ID NO: 32849 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
tagaagcagcaagaagcaag

SEQ ID NO: 32850 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
agtgttagagaatacttttc

SEQ ID NO: 32851 - DNA, 20 bp, Artificial Sequence
  Description of Artificial Sequence: Synthetic oligonucleotide
  Target: ATXN1; (+) strand; PAM type: NNNNGHTT; PAM sequence: ATATGTTT
ttctgttgttttaagccacg

SEQ ID NO: 32852 - DNA, 20 bp, Artificial Sequence
  Description of Artificial Sequence: Synthetic oligonucleotide
  Target: ATXN1; (+) strand; PAM type: NNNNGHTT; PAM sequence: TATTGATT
caatccaaatatcttccatt

SEQ ID NO: 32853 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
tactcttcataacaaatttg

SEQ ID NO: 32854 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
cattttccagataaggacac

SEQ ID NO: 32855 - DNA, 20 bp, Artificial Sequence
  Description of Artificial Sequence: Synthetic oligonucleotide
  Target: ATXN1; (+) strand; PAM type: NNNNGHTT; PAM sequence: GGATGTTT
tgaccaaggaagagaggtca

SEQ ID NO: 32856 - DNA, 20 bp, Artificial Sequence
  Description of Artificial Sequence: Synthetic oligonucleotide
  Target: ATXN1; (+) strand; PAM type: NNNNGHTT; PAM sequence: ACATGCTT
gtgaggaactgagagcacta

SEQ ID NO: 32857 - DNA, 20 bp, Artificial Sequence
  Description of Artificial Sequence: Synthetic oligonucleotide
  Target: ATXN1; (+) strand; PAM type: NNNNGHTT; PAM sequence: TAGTGTTT
attatcagcaccacgaatag

SEQ ID NO: 32858 - DNA, 20 bp, Artificial Sequence
  Description of Artificial Sequence: Synthetic oligonucleotide
  Target: ATXN1; (+) strand; PAM type: NNNNGHTT; PAM sequence: CAATGATT
ggatacgactatacttgaag

SEQ ID NO: 32859 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
atagtctcattcgggtggtc

SEQ ID NO: 32860 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
gcgtccagtggggagttgtt

SEQ ID NO: 32861 - DNA, 20 bp, Artificial Sequence
  Description of Artificial Sequence: Synthetic oligonucleotide
  Target: ATXN1; (+) strand; PAM type: NNNNGHTT; PAM sequence: GTCTGCTT
gctgccattctgctgaactt

SEQ ID NO: 32862 - DNA, 20 bp, Artificial Sequence
  Description of Artificial Sequence: Synthetic oligonucleotide
  Target: ATXN1; (+) strand; PAM type: NNNNGHTT; PAM sequence: GAGTGATT
ccttatccctaagtggggct

SEQ ID NO: 32863 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
cctgtccacataatggaggg

SEQ ID NO: 32864 - DNA, 20 bp, Artificial Sequence
  Description of Artificial Sequence: Synthetic oligonucleotide
  Target: ATXN1; (+) strand; PAM type: NNNNGHTT; PAM sequence: CTTAGATT
agggccaggcttcatcaatt

SEQ ID NO: 32865 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
gcttcatcaattcttagatt

SEQ ID NO: 32866 - DNA, 20 bp, Artificial Sequence
  Description of Artificial Sequence: Synthetic oligonucleotide
  Target: ATXN1; (+) strand; PAM type: NNNNGHTT; PAM sequence: CACAGCTT
ggaaggaggaggggcggggc

SEQ ID NO: 32867 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
ttgtctgacagaggttgagt

SEQ ID NO: 32868 - DNA, 20 bp, Artificial Sequence
  Description of Artificial Sequence: Synthetic oligonucleotide
  Target: ATXN1; (+) strand; PAM type: NNNNGHTT; PAM sequence: TCCTGATT
tgcctttctgtcaagacctt

SEQ ID NO: 32869 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
caatacagaagcaaatactt

SEQ ID NO: 32870 - DNA, 20 bp, Artificial Sequence
  Description of Artificial Sequence: Synthetic oligonucleotide
  Target: ATXN1; (+) strand; PAM type: NNNNGHTT; PAM sequence: CCACGTTT
ggttagctacccgggggcac

SEQ ID NO: 32871 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
ctacccgggggcacccacgt

SEQ ID NO: 32872 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
aaggctgggaacagttacac

SEQ ID NO: 32873 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
tctcatcccagtccagacta

SEQ ID NO: 32874 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
tgtcactttgactctcactt

SEQ ID NO: 32875 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
ggtagagaacaggttcaaac

SEQ ID NO: 32876 - DNA, 20 bp, Artificial Sequence
  Description of Artificial Sequence: Synthetic oligonucleotide
  Target: ATXN1; (+) strand; PAM type: NNNNGHTT; PAM sequence: GGCGGATT
cactttaggaggctgaggcg

SEQ ID NO: 32877 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
ggcgggcggattgcgaggtc

SEQ ID NO: 32878 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
gagggaggctaaggcaggag

SEQ ID NO: 32879 - DNA, 20 bp, Artificial Sequence
  Description of Artificial Sequence: Synthetic oligonucleotide
  Target: ATXN1; (+) strand; PAM type: NNNNGHTT; PAM sequence: TTGCGATT
aataataattttaattttac

SEQ ID NO: 32880 - DNA, 20 bp, Artificial Sequence
  Description of Artificial Sequence: Synthetic oligonucleotide
  Target: ATXN1; (+) strand; PAM type: NNNNGHTT; PAM sequence: CCAAGTTT
acttgcgattatacatgtgc

SEQ ID NO: 32881 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
aactatcaattctttcaaac

SEQ ID NO: 32882 - DNA, 20 bp, Artificial Sequence
  Description of Artificial Sequence: Synthetic oligonucleotide
  Target: ATXN1; (+) strand; PAM type: NNNNGHTT; PAM sequence: GGGTGTTT
atagaaaaagaggaagtgat

SEQ ID NO: 32883 - DNA, 20 bp, Artificial Sequence
  Description of Artificial Sequence: Synthetic oligonucleotide
  Target: ATXN1; (+) strand; PAM type: NNNNGHTT; PAM sequence: CCGTGTTT
aagggttaagtgcaatgcct

SEQ ID NO: 32884 - DNA, 20 bp, Artificial Sequence
  Description of Artificial Sequence: Synthetic oligonucleotide
  Target: ATXN1; (+) strand; PAM type: NNNNGHTT; PAM sequence: GCCTGCTT
atgcctccgtgtttcactct

SEQ ID NO: 32885 - DNA, 20 bp, Artificial Sequence
  Description of Artificial Sequence: Synthetic oligonucleotide
  Target: ATXN1; (+) strand; PAM type: NNNNGHTT; PAM sequence: ACGAGCTT
gtctacccgcacacacactc

SEQ ID NO: 32886 - DNA, 20 bp, Artificial Sequence
  Description of Artificial Sequence: Synthetic oligonucleotide
  Target: ATXN1; (+) strand; PAM type: NNNNGHTT; PAM sequence: CTGGGTTT
tcctgccagccaccaggggg

SEQ ID NO: 32887 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
tgttcctccaggtgtcacac

SEQ ID NO: 32888 - DNA, 20 bp, Artificial Sequence
  Description of Artificial Sequence: Synthetic oligonucleotide
  Target: ATXN1; (+) strand; PAM type: NNNNGHTT; PAM sequence: GGTGGTTT
cacactggcttaccttctat

SEQ ID NO: 32889 - DNA, 20 bp, Artificial Sequence
  Description of Artificial Sequence: Synthetic oligonucleotide
  Target: ATXN1; (+) strand; PAM type: NNNNGHTT; PAM sequence: CGATGCTT
acagcaggcaggacaagtca

SEQ ID NO: 32890 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
ttaatttgtgcaggctacag

SEQ ID NO: 32891 - DNA, 20 bp, Artificial Sequence
  Description of Artificial Sequence: Synthetic oligonucleotide
  Target: ATXN1; (+) strand; PAM type: NNNNGHTT; PAM sequence: CTAAGATT
tcagagtgtaagtcacttgc

SEQ ID NO: 32892 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aacctctgcctcctgggttc

SEQ ID NO: 32893 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
ttttgtatttttagtagaga

SEQ ID NO: 32894 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacctcggcctcccaaagtg

SEQ ID NO: 32895 - DNA, 20 bp, Artificial Sequence
  Description of Artificial Sequence: Synthetic oligonucleotide
  Target: ATXN1; (+) strand; PAM type: NNNNGHTT; PAM sequence: GTATGTTT
gaatgtcctgcctcacagaa

SEQ ID NO: 32896 - DNA, 20 bp, Artificial Sequence
  Description of Artificial Sequence: Synthetic oligonucleotide
  Target: ATXN1; (+) strand; PAM type: NNNNGHTT; PAM sequence: ATGTGATT
ggccactggatggagtaaca

SEQ ID NO: 32897 - DNA, 20 bp, Artificial Sequence
  Description of Artificial Sequence: Synthetic oligonucleotide
  Target: ATXN1; (+) strand; PAM type: NNNNGHTT; PAM sequence: GGGGGCTT
gtaacaatgtgatttatgat

SEQ ID NO: 32898 - DNA, 20 bp, Artificial Sequence
  Description of Artificial Sequence: Synthetic oligonucleotide
  Target: ATXN1; (+) strand; PAM type: NNNNGHTT; PAM sequence: GTGAGCTT
ctctagatgctgaggttcgc

SEQ ID NO: 32899 - DNA, 20 bp, Artificial Sequence
  Description of Artificial Sequence: Synthetic oligonucleotide
  Target: ATXN1; (+) strand; PAM type: NNNNGHTT; PAM sequence: TGGTGATT
ttcgcgtgagcttccctggt

SEQ ID NO: 32900 - DNA, 20 bp, Artificial Sequence
  Description of Artificial Sequence: Synthetic oligonucleotide
  Target: ATXN1; (+) strand; PAM type: NNNNGHTT; PAM sequence: CTAAGTTT
ctatatgcctcttaccctgg

SEQ ID NO: 32901 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
cctgtaataagtatgagtag

SEQ ID NO: 32902 - DNA, 20 bp, Artificial Sequence
  Description of Artificial Sequence: Synthetic oligonucleotide
  Target: ATXN1; (+) strand; PAM type: NNNNGHTT; PAM sequence: TGCAGATT
ttggctcccgcacttggctc

SEQ ID NO: 32903 - DNA, 20 bp, Artificial Sequence
  Description of Artificial Sequence: Synthetic oligonucleotide
  Target: ATXN1; (+) strand; PAM type: NNNNGHTT; PAM sequence: ACTGGTTT
gcacatgtacctgggacact

SEQ ID NO: 32904 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
ctgggacactactggtttca

SEQ ID NO: 32905 - DNA, 20 bp, Artificial Sequence
  Description of Artificial Sequence: Synthetic oligonucleotide
  Target: ATXN1; (+) strand; PAM type: NNNNGHTT; PAM sequence: GGGAGCTT
cggcacatcagactcaccca

SEQ ID NO: 32906 - DNA, 20 bp, Artificial Sequence
  Description of Artificial Sequence: Synthetic oligonucleotide
  Target: ATXN1; (+) strand; PAM type: NNNNGHTT; PAM sequence: AGGGGATT
ggcattttaggaaatgcacc

SEQ ID NO: 32907 - DNA, 20 bp, Artificial Sequence
  Description of Artificial Sequence: Synthetic oligonucleotide
  Target: ATXN1; (+) strand; PAM type: NNNNGHTT; PAM sequence: AGAGGATT
gaggtgagaacctctggtat

SEQ ID NO: 32908 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtagaga

SEQ ID NO: 32909 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcggcctcccaaagta

SEQ ID NO: 32910 - DNA, 20 bp, Artificial Sequence
  Description of Artificial Sequence: Synthetic oligonucleotide
  Target: ATXN1; (+) strand; PAM type: NNNNGHTT; PAM sequence: CAGTGATT
ctgtccttggcagtatgtct

SEQ ID NO: 32911 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
tcactgcacctcccaggttc

SEQ ID NO: 32912 - DNA, 20 bp, Artificial Sequence
  Description of Artificial Sequence: Synthetic oligonucleotide
  Target: ATXN1; (+) strand; PAM type: NNNNGHTT; PAM sequence: TTGGGATT
tgcctcagcctcccaagtag

SEQ ID NO: 32913 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
atttttatttttggtagaga

SEQ ID NO: 32914 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
taccttggcctcccaacgtg

SEQ ID NO: 32915 - DNA, 20 bp, Artificial Sequence
  Description of Artificial Sequence: Synthetic oligonucleotide
  Target: ATXN1; (+) strand; PAM type: NNNNGHTT; PAM sequence: CAGTGATT
ccactgagcccggcctgtct

SEQ ID NO: 32916 - DNA, 20 bp, Artificial Sequence
  Description of Artificial Sequence: Synthetic oligonucleotide
  Target: ATXN1; (+) strand; PAM type: NNNNGHTT; PAM sequence: ATATGATT
agacacaaaagaacaatatc

SEQ ID NO: 32917 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
tgggaggacggggcaatggg

SEQ ID NO: 32918 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
ttgtttaacggttccagaat

SEQ ID NO: 32919 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
ccacttaaccgtgcacgtaa

SEQ ID NO: 32920 - DNA, 20 bp, Artificial Sequence
  Description of Artificial Sequence: Synthetic oligonucleotide
  Target: ATXN1; (+) strand; PAM type: NNNNGHTT; PAM sequence: GCAGGCTT
gaatggcgtgaacctgggag

SEQ ID NO: 32921 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
aataaatatgtcatgatctt

SEQ ID NO: 32922 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
agtttgtgaacaaactgcat

SEQ ID NO: 32923 - DNA, 20 bp, Artificial Sequence
  Description of Artificial Sequence: Synthetic oligonucleotide
  Target: ATXN1; (+) strand; PAM type: NNNNGHTT; PAM sequence: ATCTGCTT
acacagcgccccgctccctc

SEQ ID NO: 32924 - DNA, 20 bp, Artificial Sequence
  Description of Artificial Sequence: Synthetic oligonucleotide
  Target: ATXN1; (+) strand; PAM type: NNNNGHTT; PAM sequence: CCCTGATT
atccctgtatgcctcttctc

SEQ ID NO: 32925 - DNA, 20 bp, Artificial Sequence
  Description of Artificial Sequence: Synthetic oligonucleotide
  Target: ATXN1; (+) strand; PAM type: NNNNGHTT; PAM sequence: TGTGGCTT
cgcggccacctagtaaatcg

SEQ ID NO: 32926 - DNA, 20 bp, Artificial Sequence
  Description of Artificial Sequence: Synthetic oligonucleotide
  Target: ATXN1; (+) strand; PAM type: NNNNGHTT; PAM sequence: ACCTGTTT
ctcctccgcaaggcactgtc

SEQ ID NO: 32927 - DNA, 20 bp, Artificial Sequence
  Description of Artificial Sequence: Synthetic oligonucleotide
  Target: ATXN1; (+) strand; PAM type: NNNNGHTT; PAM sequence: AACCGTTT
tcatccacacaccgttcagg

SEQ ID NO: 32928 - DNA, 20 bp, Artificial Sequence
  Description of Artificial Sequence: Synthetic oligonucleotide
  Target: ATXN1; (+) strand; PAM type: NNNNGHTT; PAM sequence: ACTTGATT
atggttaatactgagtgtca

SEQ ID NO: 32929 - DNA, 20 bp, Artificial Sequence
  Description of Artificial Sequence: Synthetic oligonucleotide
  Target: ATXN1; (+) strand; PAM type: NNNNGHTT; PAM sequence: ATTGGATT
taatactgagtgtcaacttg

SEQ ID NO: 32930 - DNA, 20 bp, Artificial Sequence
  Description of Artificial Sequence: Synthetic oligonucleotide
  Target: ATXN1; (+) strand; PAM type: NNNNGHTT; PAM sequence: ATGGGCTT
aggagataaacatttgggtc

SEQ ID NO: 32931 - DNA, 20 bp, Artificial Sequence
  Description of Artificial Sequence: Synthetic oligonucleotide
  Target: ATXN1; (+) strand; PAM type: NNNNGHTT; PAM sequence: GGATGCTT
cttcatctttttctcgtgct

SEQ ID NO: 32932 - DNA, 20 bp, Artificial Sequence
  Description of Artificial Sequence: Synthetic oligonucleotide
  Target: ATXN1; (+) strand; PAM type: NNNNGHTT; PAM sequence: TTCAGCTT
gaacacccgacttgaagttc

SEQ ID NO: 32933 - DNA, 20 bp, Artificial Sequence
  Description of Artificial Sequence: Synthetic oligonucleotide
  Target: ATXN1; (+) strand; PAM type: NNNNGHTT; PAM sequence: GTCGGCTT
cacaggctgaaggctgcact

SEQ ID NO: 32934 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
gggactcagactggtcaacc

SEQ ID NO: 32935 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
aaccactggcttccttgctc

SEQ ID NO: 32936 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
ccacttccggctgctgcaat

SEQ ID NO: 32937 - DNA, 20 bp, Artificial Sequence
  Description of Artificial Sequence: Synthetic oligonucleotide
  Target: ATXN1; (+) strand; PAM type: NNNNGHTT; PAM sequence: ACGTGTTT
ctgctgcaatccttgttttc

SEQ ID NO: 32938 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
cattagaccgtaaactccga

SEQ ID NO: 32939 - DNA, 20 bp, Artificial Sequence
  Description of Artificial Sequence: Synthetic oligonucleotide
  Target: ATXN1; (+) strand; PAM type: NNNNGHTT; PAM sequence: TTGGGTTT
agactgaagttcacaacccc

SEQ ID NO: 32940 - DNA, 20 bp, Artificial Sequence
  Description of Artificial Sequence: Synthetic oligonucleotide
  Target: ATXN1; (+) strand; PAM type: NNNNGHTT; PAM sequence: TGCAGTTT
cttatcttgtgtccatctct

SEQ ID NO: 32941 - DNA, 20 bp, Artificial Sequence
  Description of Artificial Sequence: Synthetic oligonucleotide
  Target: ATXN1; (+) strand; PAM type: NNNNGHTT; PAM sequence: AAAGGATT
caagctggttattaaaaggc

SEQ ID NO: 32942 - DNA, 20 bp, Artificial Sequence
  Description of Artificial Sequence: Synthetic oligonucleotide
  Target: ATXN1; (+) strand; PAM type: NNNNGHTT; PAM sequence: TCTAGATT
aaaggatttctggatcattt

SEQ ID NO: 32943 - DNA, 20 bp, Artificial Sequence
  Description of Artificial Sequence: Synthetic oligonucleotide
  Target: ATXN1; (+) strand; PAM type: NNNNGHTT; PAM sequence: TTGAGATT
atctgcaaagaatctgcccc

SEQ ID NO: 32944 - DNA, 20 bp, Artificial Sequence
  Description of Artificial Sequence: Synthetic oligonucleotide
  Target: ATXN1; (+) strand; PAM type: NNNNGHTT; PAM sequence: GTGAGATT
tttcaaacatactttctcac

SEQ ID NO: 32945 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
tccaattatccaaaactaat

SEQ ID NO: 32946 - DNA, 20 bp, Artificial Sequence
  Description of Artificial Sequence: Synthetic oligonucleotide
  Target: ATXN1; (+) strand; PAM type: NNNNGHTT; PAM sequence: TCTGGATT
aaggaaacacctcggtagtc

SEQ ID NO: 32947 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
ataagaattctctctgcaat

SEQ ID NO: 32948 - DNA, 20 bp, Artificial Sequence
  Description of Artificial Sequence: Synthetic oligonucleotide
  Target: ATXN1; (+) strand; PAM type: NNNNGHTT; PAM sequence: GTTTGTTT
gaattctctctgcaataaat

SEQ ID NO: 32949 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
tggagcccaagatggccccg

SEQ ID NO: 32950 - DNA, 20 bp, Artificial Sequence
  Description of Artificial Sequence: Synthetic oligonucleotide
  Target: ATXN1; (+) strand; PAM type: NNNNGHTT; PAM sequence: AGCTGTTT
tgggatgactcgctacctgc

SEQ ID NO: 32951 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aacctccgcctcctgggttc

SEQ ID NO: 32952 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcctgagtag

SEQ ID NO: 32953 - DNA, 20 bp, Artificial Sequence
  Description of Artificial Sequence: Synthetic oligonucleotide
  Target: ATXN1; (+) strand; PAM type: NNNNGHTT; PAM sequence: GCTAGTTT
ggcgcctgccaccatgcctg

SEQ ID NO: 32954 - DNA, 20 bp, Artificial Sequence
  Description of Artificial Sequence: Synthetic oligonucleotide
  Target: ATXN1; (+) strand; PAM type: NNNNGHTT; PAM sequence: CACCGCTT
ctcccaaagtgggagtgagc

SEQ ID NO: 32955 - DNA, 20 bp, Artificial Sequence
  Description of Artificial Sequence: Synthetic oligonucleotide
  Target: ATXN1; (+) strand; PAM type: NNNNGHTT; PAM sequence: TTGGGATT
aagtgggagtgagccaccgc

SEQ ID NO: 32956 - DNA, 20 bp, Artificial Sequence
  Description of Artificial Sequence: Synthetic oligonucleotide
  Target: ATXN1; (+) strand; PAM type: NNNNGHTT; PAM sequence: AGTTGATT
ctcctgagcaggaagcacat

SEQ ID NO: 32957 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
ccaaggccagagccggctcc

SEQ ID NO: 32958 - DNA, 20 bp, Artificial Sequence
  Description of Artificial Sequence: Synthetic oligonucleotide
  Target: ATXN1; (+) strand; PAM type: NNNNGHTT; PAM sequence: CGTTGCTT
gtgggaacccgggctgcgcg

SEQ ID NO: 32959 - DNA, 20 bp, Artificial Sequence
  Description of Artificial Sequence: Synthetic oligonucleotide
  Target: ATXN1; (+) strand; PAM type: NNNNGHTT; PAM sequence: AGGGGCTT
ccgccggccctagggcagtg

SEQ ID NO: 32960 - DNA, 20 bp, Artificial Sequence
  Description of Artificial Sequence: Synthetic oligonucleotide
  Target: ATXN1; (+) strand; PAM type: NNNNGHTT; PAM sequence: AAGGGATT
gagaacctttatgtctagct

SEQ ID NO: 32961 - DNA, 20 bp, Artificial Sequence
  Description of Artificial Sequence: Synthetic oligonucleotide
  Target: ATXN1; (+) strand; PAM type: NNNNGHTT; PAM sequence: CAAGGTTT
tcagcactctatatctagct

SEQ ID NO: 32962 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
tcagcaccctgtgtctagct

SEQ ID NO: 32963 - DNA, 20 bp, Artificial Sequence
  Description of Artificial Sequence: Synthetic oligonucleotide
  Target: ATXN1; (+) strand; PAM type: NNNNGHTT; PAM sequence: AAGGGATT
gagaacctttatgtctagct

SEQ ID NO: 32964 - DNA, 20 bp, Artificial Sequence
  Description of Artificial Sequence: Synthetic oligonucleotide
  Target: ATXN1; (+) strand; PAM type: NNNNGHTT; PAM sequence: CAAGGTTT
tcggcactctgtatctagct

SEQ ID NO: 32965 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
tcagcaccctgtgtctagct

SEQ ID NO: 32966 - DNA, 20 bp, Artificial Sequence
  Description of Artificial Sequence: Synthetic oligonucleotide
  Target: ATXN1; (+) strand; PAM type: NNNNGHTT; PAM sequence: CAGGGATT
gagaacctttgtgtctagct

SEQ ID NO: 32967 - DNA, 20 bp, Artificial Sequence
  Description of Artificial Sequence: Synthetic oligonucleotide
  Target: ATXN1; (+) strand; PAM type: NNNNGHTT; PAM sequence: GGAAGCTT
ccgatccctttccacactgt

SEQ ID NO: 32968 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
taacactcaccggaaaggtc

SEQ ID NO: 32969 - DNA, 20 bp, Artificial Sequence
  Description of Artificial Sequence: Synthetic oligonucleotide
  Target: ATXN1; (+) strand; PAM type: NNNNGHTT; PAM sequence: TGCCGCTT
ggaatgaacaactccagaca

SEQ ID NO: 32970 - DNA, 20 bp, Artificial Sequence
  Description of Artificial Sequence: Synthetic oligonucleotide
  Target: ATXN1; (+) strand; PAM type: NNNNGHTT; PAM sequence: CACGGCTT
taacactcaccgcaagggtc

SEQ ID NO: 32971 - DNA, 20 bp, Artificial Sequence
  Description of Artificial Sequence: Synthetic oligonucleotide
  Target: ATXN1; (+) strand; PAM type: NNNNGHTT; PAM sequence: CATAGTTT
tctggacacagtagcacaac

SEQ ID NO: 32972 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
ctccctgtgctcaagtgatc

SEQ ID NO: 32973 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
atcctcagcttccttagtag

SEQ ID NO: 32974 - DNA, 20 bp, Artificial Sequence
  Description of Artificial Sequence: Synthetic oligonucleotide
  Target: ATXN1; (+) strand; PAM type: NNNNGHTT; PAM sequence: TAGGGTTT
tttaaacttttttattcaga

SEQ ID NO: 32975 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
tgcaggctggtctcaaactc

SEQ ID NO: 32976 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
ggcttaagcgatcctcccat

SEQ ID NO: 32977 - DNA, 20 bp, Artificial Sequence
  Description of Artificial Sequence: Synthetic oligonucleotide
  Target: ATXN1; (+) strand; PAM type: NNNNGHTT; PAM sequence: CTAAGCTT
caccgggcccattcaacttt

SEQ ID NO: 32978 - DNA, 20 bp, Artificial Sequence
  Description of Artificial Sequence: Synthetic oligonucleotide
  Target: ATXN1; (+) strand; PAM type: NNNNGHTT; PAM sequence: CTTTGATT
ggcccattcaactttctaag

SEQ ID NO: 32979 - DNA, 20 bp, Artificial Sequence
  Description of Artificial Sequence: Synthetic oligonucleotide
  Target: ATXN1; (+) strand; PAM type: NNNNGHTT; PAM sequence: CCGGGCTT
aaaaatacaaaaaaaattag

SEQ ID NO: 32980 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
gaggtggaggttgcagcgaa

SEQ ID NO: 32981 - DNA, 20 bp, Artificial Sequence
  Description of Artificial Sequence: Synthetic oligonucleotide
  Target: ATXN1; (+) strand; PAM type: NNNNGHTT; PAM sequence: AACTGCTT
aaatgctacctctcatgatg

SEQ ID NO: 32982 - DNA, 20 bp, Artificial Sequence
  Description of Artificial Sequence: Synthetic oligonucleotide
  Target: ATXN1; (+) strand; PAM type: NNNNGHTT; PAM sequence: ACCTGATT
acaggcctgggatctaggcc

SEQ ID NO: 32983 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
actaattcatttctctgtgc

SEQ ID NO: 32984 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
ataatactagttcctacccc

SEQ ID NO: 32985 - DNA, 20 bp, Artificial Sequence
  Description of Artificial Sequence: Synthetic oligonucleotide
  Target: ATXN1; (+) strand; PAM type: NNNNGHTT; PAM sequence: TTCCGATT
acaattactggctgtggttg

SEQ ID NO: 32986 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
tcctggccaacatggtgaca

SEQ ID NO: 32987 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
gaatggaataatctctcatt

SEQ ID NO: 32988 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
tttcaagtcttaccggttca

SEQ ID NO: 32989 - DNA, 20 bp, Artificial Sequence
  Description of Artificial Sequence: Synthetic oligonucleotide
  Target: ATXN1; (+) strand; PAM type: NNNNGHTT; PAM sequence: CACTGATT
gaaaatactccacactagtg

SEQ ID NO: 32990 - DNA, 20 bp, Artificial Sequence
  Description of Artificial Sequence: Synthetic oligonucleotide
  Target: ATXN1; (+) strand; PAM type: NNNNGHTT; PAM sequence: CCTTGTTT
ccccctaaactggaccaaag

SEQ ID NO: 32991 - DNA, 20 bp, Artificial Sequence
  Description of Artificial Sequence: Synthetic oligonucleotide
  Target: ATXN1; (+) strand; PAM type: NNNNGHTT; PAM sequence: TCATGTTT
aaaataaaattcaaatgtgc

SEQ ID NO: 32992 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
gttttcaatttaagtatgtc

SEQ ID NO: 32993 - DNA, 20 bp, Artificial Sequence
  Description of Artificial Sequence: Synthetic oligonucleotide
  Target: ATXN1; (+) strand; PAM type: NNNNGHTT; PAM sequence: TGCTGTTT
atttaagtatgtctgttgtt

SEQ ID NO: 32994 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
tttattcctttggtataaat

SEQ ID NO: 32995 - DNA, 20 bp, Artificial Sequence
  Description of Artificial Sequence: Synthetic oligonucleotide
  Target: ATXN1; (+) strand; PAM type: NNNNGHTT; PAM sequence: TCTGGCTT
tttggtataaatagaagctt

SEQ ID NO: 32996 - DNA, 20 bp, Artificial Sequence
  Description of Artificial Sequence: Synthetic oligonucleotide
  Target: ATXN1; (+) strand; PAM type: NNNNGHTT; PAM sequence: CACTGTTT
tgaacgcagaacacatagta

SEQ ID NO: 32997 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
ttattcattataaattaaat

SEQ ID NO: 32998 - DNA, 20 bp, Artificial Sequence
  Description of Artificial Sequence: Synthetic oligonucleotide
  Target: ATXN1; (+) strand; PAM type: NNNNGHTT; PAM sequence: TAACGATT
ataaaaacataaaatatgac

SEQ ID NO: 32999 - DNA, 20 bp, Artificial Sequence
  Description of Artificial Sequence: Synthetic oligonucleotide
  Target: ATXN1; (+) strand; PAM type: NNNNGHTT; PAM sequence: TCCTGTTT
gcaaaaaaagtaaggcagtc

SEQ ID NO: 33000 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
tgcagttaacctctgtaagc

SEQ ID NO: 33001 - DNA, 20 bp, Artificial Sequence
  Description of Artificial Sequence: Synthetic oligonucleotide
  Target: ATXN1; (+) strand; PAM type: NNNNGHTT; PAM sequence: ATACGTTT
ggaatatgtgaatgatgata

SEQ ID NO: 33002 - DNA, 20 bp, Artificial Sequence
  Description of Artificial Sequence: Synthetic oligonucleotide
  Target: ATXN1; (+) strand; PAM type: NNNNGHTT; PAM sequence: AAAAGATT
aatgatgataatacgttttc

SEQ ID NO: 33003 - DNA, 20 bp, Artificial Sequence
  Description of Artificial Sequence: Synthetic oligonucleotide
  Target: ATXN1; (+) strand; PAM type: NNNNGHTT; PAM sequence: GGATGCTT
tctgtgaggaatttccactt

SEQ ID NO: 33004 - DNA, 20 bp, Artificial Sequence
  Description of Artificial Sequence: Synthetic oligonucleotide
  Target: ATXN1; (+) strand; PAM type: NNNNGHTT; PAM sequence: AACGGTTT
tccggttccatatttctgct

SEQ ID NO: 33005 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
aaatgtctcaactcttgggg

SEQ ID NO: 33006 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
atttactgtgtaggaaagaa

SEQ ID NO: 33007 - DNA, 20 bp, Artificial Sequence
  Description of Artificial Sequence: Synthetic oligonucleotide
  Target: ATXN1; (+) strand; PAM type: NNNNGHTT; PAM sequence: GAAGGATT
tgtccctatttgtggggagg

SEQ ID NO: 33008 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
gcaaatcaccgaacccaagc

SEQ ID NO: 33009 - DNA, 20 bp, Artificial Sequence
  Description of Artificial Sequence: Synthetic oligonucleotide
  Target: ATXN1; (+) strand; PAM type: NNNNGHTT; PAM sequence: GCATGCTT
atttaggcaggtgtggtggt

SEQ ID NO: 33010 - DNA, 20 bp, Artificial Sequence
  Description of Artificial Sequence: Synthetic oligonucleotide
  Target: ATXN1; (+) strand; PAM type: NNNNGHTT; PAM sequence: GGAGGATT
caacttgggaggctgaggtg

SEQ ID NO: 33011 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
ttgggaggctgaggtgggag

SEQ ID NO: 33012 - DNA, 20 bp, Artificial Sequence
  Description of Artificial Sequence: Synthetic oligonucleotide
  Target: ATXN1; (+) strand; PAM type: NNNNGHTT; PAM sequence: AGAGGATT
agaacatgaaggaaatgggc

SEQ ID NO: 33013 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
aggattccagcagaattctg

SEQ ID NO: 33014 - DNA, 20 bp, Artificial Sequence
  Description of Artificial Sequence: Synthetic oligonucleotide
  Target: ATXN1; (+) strand; PAM type: NNNNGHTT; PAM sequence: TCCTGATT
tgccaagattttcagtcttt

SEQ ID NO: 33015 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
agagcatttccattttcatt

SEQ ID NO: 33016 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
aaaccaatttttcccccagt

SEQ ID NO: 33017 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
agtgaatgtttttttaattt

SEQ ID NO: 33018 - DNA, 20 bp, Artificial Sequence
  Description of Artificial Sequence: Synthetic oligonucleotide
  Target: ATXN1; (+) strand; PAM type: NNNNGHTT; PAM sequence: TGTAGCTT
gtggcccaatcttggctcac

SEQ ID NO: 33019 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
caccacgcccagctaatttt

SEQ ID NO: 33020 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttttgtagtttttgtagaga

SEQ ID NO: 33021 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
acggggtttcaccatgttgt

SEQ ID NO: 33022 - DNA, 20 bp, Artificial Sequence
  Description of Artificial Sequence: Synthetic oligonucleotide
  Target: ATXN1; (+) strand; PAM type: NNNNGHTT; PAM sequence: CGCAGCTT
accaggcctcctttcagtat

SEQ ID NO: 33023 - DNA, 20 bp, Artificial Sequence
  Description of Artificial Sequence: Synthetic oligonucleotide
  Target: ATXN1; (+) strand; PAM type: NNNNGHTT; PAM sequence: CCCTGATT
agcttgagcctgtcagcatc

SEQ ID NO: 33024 - DNA, 20 bp, Artificial Sequence
  Description of Artificial Sequence: Synthetic oligonucleotide
  Target: ATXN1; (+) strand; PAM type: NNNNGHTT; PAM sequence: TTTGGATT
tggtctttcacagcatttac

SEQ ID NO: 33025 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
agtgaggtctctctttcagt

SEQ ID NO: 33026 - DNA, 20 bp, Artificial Sequence
  Description of Artificial Sequence: Synthetic oligonucleotide
  Target: ATXN1; (+) strand; PAM type: NNNNGHTT; PAM sequence: GTTAGTTT
gagattatttcttagaacag

SEQ ID NO: 33027 - DNA, 20 bp, Artificial Sequence
  Description of Artificial Sequence: Synthetic oligonucleotide
  Target: ATXN1; (+) strand; PAM type: NNNNGHTT; PAM sequence: AGAGGCTT
ttgctaaaatataaataagc

SEQ ID NO: 33028 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
acttggatctttttccctgc

SEQ ID NO: 33029 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
tgctatagtttcgcgaataa

SEQ ID NO: 33030 - DNA, 20 bp, Artificial Sequence
  Description of Artificial Sequence: Synthetic oligonucleotide
  Target: ATXN1; (+) strand; PAM type: NNNNGHTT; PAM sequence: GTTTGCTT
atagtttcgcgaataatata

SEQ ID NO: 33031 - DNA, 20 bp, Artificial Sequence
  Description of Artificial Sequence: Synthetic oligonucleotide
  Target: ATXN1; (+) strand; PAM type: NNNNGHTT; PAM sequence: TAACGTTT
agtgactgagtctcaatcta

SEQ ID NO: 33032 - DNA, 20 bp, Artificial Sequence
  Description of Artificial Sequence: Synthetic oligonucleotide
  Target: ATXN1; (+) strand; PAM type: NNNNGHTT; PAM sequence: GTGGGTTT
atgagtaatgccttagatgg

SEQ ID NO: 33033 - DNA, 20 bp, Artificial Sequence
  Description of Artificial Sequence: Synthetic oligonucleotide
  Target: ATXN1; (+) strand; PAM type: NNNNGHTT; PAM sequence: TTTTGTTT
taatgccttagatgggtggg

SEQ ID NO: 33034 - DNA, 20 bp, Artificial Sequence
  Description of Artificial Sequence: Synthetic oligonucleotide
  Target: ATXN1; (+) strand; PAM type: NNNNGHTT; PAM sequence: AGCTGATT
tgggttttgttttctttcac

SEQ ID NO: 33035 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
ctcaatgacactgtagaaga

SEQ ID NO: 33036 - DNA, 20 bp, Artificial Sequence
  Description of Artificial Sequence: Synthetic oligonucleotide
  Target: ATXN1; (+) strand; PAM type: NNNNGHTT; PAM sequence: CATGGATT
gataatgttttaacaaaacg

SEQ ID NO: 33037 - DNA, 20 bp, Artificial Sequence
  Description of Artificial Sequence: Synthetic oligonucleotide
  Target: ATXN1; (+) strand; PAM type: NNNNGHTT; PAM sequence: ACAAGCTT
ttaacaaaacgcatggattt

SEQ ID NO: 33038 - DNA, 20 bp, Artificial Sequence
  Description of Artificial Sequence: Synthetic oligonucleotide
  Target: ATXN1; (+) strand; PAM type: NNNNGHTT; PAM sequence: GTCAGATT
agcatcatggcagagttatt

SEQ ID NO: 33039 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
agtaccaaaccctatgtacg

SEQ ID NO: 33040 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
ctatatatacatacctacga

SEQ ID NO: 33041 - DNA, 20 bp, Artificial Sequence
  Description of Artificial Sequence: Synthetic oligonucleotide
  Target: ATXN1; (+) strand; PAM type: NNNNGHTT; PAM sequence: GTTTGATT
atatacatacctacgataaa

SEQ ID NO: 33042 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
atttatacattaggcacagt

SEQ ID NO: 33043 - DNA, 20 bp, Artificial Sequence
  Description of Artificial Sequence: Synthetic oligonucleotide
  Target: ATXN1; (+) strand; PAM type: NNNNGHTT; PAM sequence: GAACGATT
taatagctaataataaaata

SEQ ID NO: 33044 - DNA, 20 bp, Artificial Sequence
  Description of Artificial Sequence: Synthetic oligonucleotide
  Target: ATXN1; (+) strand; PAM type: NNNNGHTT; PAM sequence: AAGTGCTT
aacagtatgccagcatcact

SEQ ID NO: 33045 - DNA, 20 bp, Artificial Sequence
  Description of Artificial Sequence: Synthetic oligonucleotide
  Target: ATXN1; (+) strand; PAM type: NNNNGHTT; PAM sequence: GGACGATT
agcggacaagctggagaaag

SEQ ID NO: 33046 - DNA, 20 bp, Artificial Sequence
  Description of Artificial Sequence: Synthetic oligonucleotide
  Target: ATXN1; (+) strand; PAM type: NNNNGHTT; PAM sequence: GTGAGATT
gcgttaggatggggtaaggc

SEQ ID NO: 33047 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
cacgcaacttaaaacttagg

SEQ ID NO: 33048 - DNA, 20 bp, Artificial Sequence
  Description of Artificial Sequence: Synthetic oligonucleotide
  Target: ATXN1; (+) strand; PAM type: NNNNGHTT; PAM sequence: AGTGGCTT
gggaatgctgctggttggtt

SEQ ID NO: 33049 - DNA, 20 bp, Artificial Sequence
  Description of Artificial Sequence: Synthetic oligonucleotide
  Target: ATXN1; (+) strand; PAM type: NNNNGHTT; PAM sequence: GTCTGATT
gttagtggcttcagaaaggt

SEQ ID NO: 33050 - DNA, 20 bp, Artificial Sequence
  Description of Artificial Sequence: Synthetic oligonucleotide
  Target: ATXN1; (+) strand; PAM type: NNNNGHTT; PAM sequence: GGTGGCTT
tacaaaaattagccaggcat

SEQ ID NO: 33051 - DNA, 20 bp, Artificial Sequence
  Description of Artificial Sequence: Synthetic oligonucleotide
  Target: ATXN1; (+) strand; PAM type: NNNNGHTT; PAM sequence: CTGAGATT
gaggcggaggttgcaatgag

SEQ ID NO: 33052 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
ttaaacttgaagcagtgaaa

SEQ ID NO: 33053 - DNA, 20 bp, Artificial Sequence
  Description of Artificial Sequence: Synthetic oligonucleotide
  Target: ATXN1; (+) strand; PAM type: NNNNGHTT; PAM sequence: TTATGCTT
aataaaaactgctacaggca

SEQ ID NO: 33054 - DNA, 20 bp, Artificial Sequence
  Description of Artificial Sequence: Synthetic oligonucleotide
  Target: ATXN1; (+) strand; PAM type: NNNNGHTT; PAM sequence: TGTAGTTT
ctgtaaaaatacacatcctc

SEQ ID NO: 33055 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
tacacatcctctgtagtttc

SEQ ID NO: 33056 - DNA, 20 bp, Artificial Sequence
  Description of Artificial Sequence: Synthetic oligonucleotide
  Target: ATXN1; (+) strand; PAM type: NNNNGHTT; PAM sequence: TGGTGATT
tgtattttaaaaatctcttt

SEQ ID NO: 33057 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
ttaaaaatctcttttggtga

SEQ ID NO: 33058 - DNA, 20 bp, Artificial Sequence
  Description of Artificial Sequence: Synthetic oligonucleotide
  Target: ATXN1; (+) strand; PAM type: NNNNGHTT; PAM sequence: CTGTGCTT
ggggaactactacactagac

SEQ ID NO: 33059 - DNA, 20 bp, Artificial Sequence
  Description of Artificial Sequence: Synthetic oligonucleotide
  Target: ATXN1; (+) strand; PAM type: NNNNGHTT; PAM sequence: GAAAGATT
cagcacaggagaatcacctg

SEQ ID NO: 33060 - DNA, 20 bp, Artificial Sequence
  Description of Artificial Sequence: Synthetic oligonucleotide
  Target: ATXN1; (+) strand; PAM type: NNNNGHTT; PAM sequence: CAGTGATT
tatagggtcggagtgggtat

SEQ ID NO: 33061 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aacctctgcctcctgggttc

SEQ ID NO: 33062 - DNA, 20 bp, Artificial Sequence
  Description of Artificial Sequence: Synthetic oligonucleotide
  Target: ATXN1; (+) strand; PAM type: NNNNGHTT; PAM sequence: ACGGGATT
tttttgtatttttagtagag

SEQ ID NO: 33063 - DNA, 20 bp, Artificial Sequence
  Description of Artificial Sequence: Synthetic oligonucleotide
  Target: ATXN1; (+) strand; PAM type: NNNNGHTT; PAM sequence: TGGGGATT
tgcctcagcctcccaaagtg

SEQ ID NO: 33064 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
aaagctgggttacacatgga

SEQ ID NO: 33065 - DNA, 20 bp, Artificial Sequence
  Description of Artificial Sequence: Synthetic oligonucleotide
  Target: ATXN1; (+) strand; PAM type: NNNNGHTT; PAM sequence: CCAAGCTT
tggaatttgtttgtattaaa

SEQ ID NO: 33066 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
caaaatcgagtccttttaaa

SEQ ID NO: 33067 - DNA, 20 bp, Artificial Sequence
  Description of Artificial Sequence: Synthetic oligonucleotide
  Target: ATXN1; (+) strand; PAM type: NNNNGHTT; PAM sequence: AGTTGCTT
agagctctaaaaagaacctt

SEQ ID NO: 33068 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
acatcctctctgggttgttc

SEQ ID NO: 33069 - DNA, 20 bp, Artificial Sequence
  Description of Artificial Sequence: Synthetic oligonucleotide
  Target: ATXN1; (+) strand; PAM type: NNNNGHTT; PAM sequence: CTCAGATT
attcatcacaaatgtcaggt

SEQ ID NO: 33070 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
gtcctctattatgtatggtg

SEQ ID NO: 33071 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
ccatcttcccttggactggc

SEQ ID NO: 33072 - DNA, 20 bp, Artificial Sequence
  Description of Artificial Sequence: Synthetic oligonucleotide
  Target: ATXN1; (+) strand; PAM type: NNNNGHTT; PAM sequence: GCTTGCTT
cttcccttggactggcctgg

SEQ ID NO: 33073 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
ttggactggcctgggcttgc

SEQ ID NO: 33074 - DNA, 20 bp, Artificial Sequence
  Description of Artificial Sequence: Synthetic oligonucleotide
  Target: ATXN1; (+) strand; PAM type: NNNNGHTT; PAM sequence: CCCAGCTT
tcagtttgctgagagcagaa

SEQ ID NO: 33075 - DNA, 20 bp, Artificial Sequence
  Description of Artificial Sequence: Synthetic oligonucleotide
  Target: ATXN1; (+) strand; PAM type: NNNNGHTT; PAM sequence: ATGAGCTT
agcagtgtcgaccctgatgg

SEQ ID NO: 33076 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcctgagtag

SEQ ID NO: 33077 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttttctatttttagtagaga

SEQ ID NO: 33078 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgccttggcctcccaaagtg

SEQ ID NO: 33079 - DNA, 20 bp, Artificial Sequence
  Description of Artificial Sequence: Synthetic oligonucleotide
  Target: ATXN1; (+) strand; PAM type: NNNNGHTT; PAM sequence: TCCTGCTT
gggcaacttgagctgccctc

SEQ ID NO: 33080 - DNA, 20 bp, Artificial Sequence
  Description of Artificial Sequence: Synthetic oligonucleotide
  Target: ATXN1; (+) strand; PAM type: NNNNGHTT; PAM sequence: TGAAGTTT
attcctcttgctcacatctg

SEQ ID NO: 33081 - DNA, 20 bp, Artificial Sequence
  Description of Artificial Sequence: Synthetic oligonucleotide
  Target: ATXN1; (+) strand; PAM type: NNNNGHTT; PAM sequence: CACGGATT
taaaaaatcgtggcacaggt

SEQ ID NO: 33082 - DNA, 20 bp, Artificial Sequence
  Description of Artificial Sequence: Synthetic oligonucleotide
  Target: ATXN1; (+) strand; PAM type: NNNNGHTT; PAM sequence: CCCTGCTT
tcacggattttcttcctcct

SEQ ID NO: 33083 - DNA, 20 bp, Artificial Sequence
  Description of Artificial Sequence: Synthetic oligonucleotide
  Target: ATXN1; (+) strand; PAM type: NNNNGHTT; PAM sequence: AAAGGTTT
tgactcagaaggttcaaagc

SEQ ID NO: 33084 - DNA, 20 bp, Artificial Sequence
  Description of Artificial Sequence: Synthetic oligonucleotide
  Target: ATXN1; (+) strand; PAM type: NNNNGHTT; PAM sequence: CTGAGTTT
ggttccactgctgtctcaca

SEQ ID NO: 33085 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
ttatgggaatagtaatgaat

SEQ ID NO: 33086 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
aattgttagtattttcccca

SEQ ID NO: 33087 - DNA, 20 bp, Artificial Sequence
  Description of Artificial Sequence: Synthetic oligonucleotide
  Target: ATXN1; (+) strand; PAM type: NNNNGHTT; PAM sequence: CTCAGTTT
agtagactgaattacaatac

SEQ ID NO: 33088 - DNA, 20 bp, Artificial Sequence
  Description of Artificial Sequence: Synthetic oligonucleotide
  Target: ATXN1; (+) strand; PAM type: NNNNGHTT; PAM sequence: AGCCGTTT
aggacaaatgataccaggaa

SEQ ID NO: 33089 - DNA, 20 bp, Artificial Sequence
  Description of Artificial Sequence: Synthetic oligonucleotide
  Target: ATXN1; (+) strand; PAM type: NNNNGHTT; PAM sequence: TCCAGTTT
atgcagaccaccctgggtta

SEQ ID NO: 33090 - DNA, 20 bp, Artificial Sequence
  Description of Artificial Sequence: Synthetic oligonucleotide
  Target: ATXN1; (+) strand; PAM type: NNNNGHTT; PAM sequence: CCACGTTT
ctagacaaacttcttttgga

SEQ ID NO: 33091 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
gaccacgtttctttcctaag

SEQ ID NO: 33092 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
gaatcttgagcaaaacaaac

SEQ ID NO: 33093 - DNA, 20 bp, Artificial Sequence
  Description of Artificial Sequence: Synthetic oligonucleotide
  Target: ATXN1; (+) strand; PAM type: NNNNGHTT; PAM sequence: TCTAGATT
caccaaaaaaattctggaga

SEQ ID NO: 33094 - DNA, 20 bp, Artificial Sequence
  Description of Artificial Sequence: Synthetic oligonucleotide
  Target: ATXN1; (+) strand; PAM type: NNNNGHTT; PAM sequence: GCTGGTTT
tttcaccaacagtctcaaat

SEQ ID NO: 33095 - DNA, 20 bp, Artificial Sequence
  Description of Artificial Sequence: Synthetic oligonucleotide
  Target: ATXN1; (+) strand; PAM type: NNNNGHTT; PAM sequence: CATCGATT
tggaatttatgcaaattcca

SEQ ID NO: 33096 - DNA, 20 bp, Artificial Sequence
  Description of Artificial Sequence: Synthetic oligonucleotide
  Target: ATXN1; (+) strand; PAM type: NNNNGHTT; PAM sequence: TGCAGCTT
tagttattccatttataaaa

SEQ ID NO: 33097 - DNA, 20 bp, Artificial Sequence
  Description of Artificial Sequence: Synthetic oligonucleotide
  Target: ATXN1; (+) strand; PAM type: NNNNGHTT; PAM sequence: ATGGGTTT
atatgcactactaaggtcct

SEQ ID NO: 33098 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
atttattttattttattttt

SEQ ID NO: 33099 - DNA, 20 bp, Artificial Sequence
  Description of Artificial Sequence: Synthetic oligonucleotide
  Target: ATXN1; (+) strand; PAM type: NNNNGHTT; PAM sequence: GCGAGATT
tttttgtatttttggtagag

SEQ ID NO: 33100 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacatcggcctcccaaagtg

SEQ ID NO: 33101 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
ctggccaagacattttaatt

SEQ ID NO: 33102 - DNA, 20 bp, Artificial Sequence
  Description of Artificial Sequence: Synthetic oligonucleotide
  Target: ATXN1; (+) strand; PAM type: NNNNGHTT; PAM sequence: GAATGATT
aaaaattggcaaggctcgag

SEQ ID NO: 33103 - DNA, 20 bp, Artificial Sequence
  Description of Artificial Sequence: Synthetic oligonucleotide
  Target: ATXN1; (+) strand; PAM type: NNNNGHTT; PAM sequence: TTTAGCTT
aataaagatagtaagaccca

SEQ ID NO: 33104 - DNA, 20 bp, Artificial Sequence
  Description of Artificial Sequence: Synthetic oligonucleotide
  Target: ATXN1; (+) strand; PAM type: NNNNGHTT; PAM sequence: TGGAGATT
aaccactatggaaaacagtg

SEQ ID NO: 33105 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
tgaaaaagatacttgcacat

SEQ ID NO: 33106 - DNA, 20 bp, Artificial Sequence
  Description of Artificial Sequence: Synthetic oligonucleotide
  Target: ATXN1; (+) strand; PAM type: NNNNGHTT; PAM sequence: ACCTGTTT
aaataatagcattcacagca

SEQ ID NO: 33107 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
ctctgaggtccataaaagcc

SEQ ID NO: 33108 - DNA, 20 bp, Artificial Sequence
  Description of Artificial Sequence: Synthetic oligonucleotide
  Target: ATXN1; (+) strand; PAM type: NNNNGHTT; PAM sequence: GAGTGCTT
gctaccctctctgctaagag

SEQ ID NO: 33109 - DNA, 20 bp, Artificial Sequence
  Description of Artificial Sequence: Synthetic oligonucleotide
  Target: ATXN1; (+) strand; PAM type: NNNNGHTT; PAM sequence: ATCTGCTT
gctgaacactcaatgggacg

SEQ ID NO: 33110 - DNA, 20 bp, Artificial Sequence
  Description of Artificial Sequence: Synthetic oligonucleotide
  Target: ATXN1; (+) strand; PAM type: NNNNGHTT; PAM sequence: TTGGGCTT
tctggacgcaggacaaaaac

SEQ ID NO: 33111 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
ttaaaaggcgttgcggccac

SEQ ID NO: 33112 - DNA, 20 bp, Artificial Sequence
  Description of Artificial Sequence: Synthetic oligonucleotide
  Target: ATXN1; (+) strand; PAM type: NNNNGHTT; PAM sequence: ATTGGATT
cagaaagactaagaatggcc

SEQ ID NO: 33113 - DNA, 20 bp, Artificial Sequence
  Description of Artificial Sequence: Synthetic oligonucleotide
  Target: ATXN1; (+) strand; PAM type: NNNNGHTT; PAM sequence: GAGAGCTT
gctgaatattagaagcaccg

SEQ ID NO: 33114 - DNA, 20 bp, Artificial Sequence
  Description of Artificial Sequence: Synthetic oligonucleotide
  Target: ATXN1; (+) strand; PAM type: NNNNGHTT; PAM sequence: ACTGGATT
cagaatctgaattaatgccc

SEQ ID NO: 33115 - DNA, 20 bp, Artificial Sequence
  Description of Artificial Sequence: Synthetic oligonucleotide
  Target: ATXN1; (+) strand; PAM type: NNNNGHTT; PAM sequence: ATGTGTTT
tatacccagtgacatcggaa

SEQ ID NO: 33116 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
cggaaatgtgttttccattc

SEQ ID NO: 33117 - DNA, 20 bp, Artificial Sequence
  Description of Artificial Sequence: Synthetic oligonucleotide
  Target: ATXN1; (+) strand; PAM type: NNNNGHTT; PAM sequence: ATGTGCTT
acatatgtcaatgggaaata

SEQ ID NO: 33118 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
agcatttgaacatctcatgc

SEQ ID NO: 33119 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
agcctcccacatcacgaagc

SEQ ID NO: 33120 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
ctcttggaaaacactgttcc

SEQ ID NO: 33121 - DNA, 20 bp, Artificial Sequence
  Description of Artificial Sequence: Synthetic oligonucleotide
  Target: ATXN1; (+) strand; PAM type: NNNNGHTT; PAM sequence: ACGGGTTT
tcttgtttgctccctcttca

SEQ ID NO: 33122 - DNA, 20 bp, Artificial Sequence
  Description of Artificial Sequence: Synthetic oligonucleotide
  Target: ATXN1; (+) strand; PAM type: NNNNGHTT; PAM sequence: TTAGGTTT
agaaatgtgatccagcaact

SEQ ID NO: 33123 - DNA, 20 bp, Artificial Sequence
  Description of Artificial Sequence: Synthetic oligonucleotide
  Target: ATXN1; (+) strand; PAM type: NNNNGHTT; PAM sequence: CGCAGCTT
cccaaggacaagatgtagct

SEQ ID NO: 33124 - DNA, 20 bp, Artificial Sequence
  Description of Artificial Sequence: Synthetic oligonucleotide
  Target: ATXN1; (+) strand; PAM type: NNNNGHTT; PAM sequence: TAGTGATT
attcatagccaaaagggtaa

SEQ ID NO: 33125 - DNA, 20 bp, Artificial Sequence
  Description of Artificial Sequence: Synthetic oligonucleotide
  Target: ATXN1; (+) strand; PAM type: NNNNGHTT; PAM sequence: TAATGTTT
aagagagggatgagagaacg

SEQ ID NO: 33126 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
aacgtaatgtttccttcaca

SEQ ID NO: 33127 - DNA, 20 bp, Artificial Sequence
  Description of Artificial Sequence: Synthetic oligonucleotide
  Target: ATXN1; (+) strand; PAM type: NNNNGHTT; PAM sequence: ACAGGATT
cttcacattctgtttctgaa

SEQ ID NO: 33128 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
ttcagatctctttaaaacaa

SEQ ID NO: 33129 - DNA, 20 bp, Artificial Sequence
  Description of Artificial Sequence: Synthetic oligonucleotide
  Target: ATXN1; (+) strand; PAM type: NNNNGHTT; PAM sequence: GATGGATT
acagccttgaggaaatatct

SEQ ID NO: 33130 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
ctgatggattgtctcaggag

SEQ ID NO: 33131 - DNA, 20 bp, Artificial Sequence
  Description of Artificial Sequence: Synthetic oligonucleotide
  Target: ATXN1; (+) strand; PAM type: NNNNGHTT; PAM sequence: TGTAGATT
agcagtgttttgggaataaa

SEQ ID NO: 33132 - DNA, 20 bp, Artificial Sequence
  Description of Artificial Sequence: Synthetic oligonucleotide
  Target: ATXN1; (+) strand; PAM type: NNNNGHTT; PAM sequence: AGAAGATT
cagtaataaattttactccc

SEQ ID NO: 33133 - DNA, 20 bp, Artificial Sequence
  Description of Artificial Sequence: Synthetic oligonucleotide
  Target: ATXN1; (+) strand; PAM type: NNNNGHTT; PAM sequence: AGTTGTTT
tcctcctcctacaatccccc

SEQ ID NO: 33134 - DNA, 20 bp, Artificial Sequence
  Description of Artificial Sequence: Synthetic oligonucleotide
  Target: ATXN1; (+) strand; PAM type: NNNNGHTT; PAM sequence: TCTGGCTT
tcagatgcataattcagttg

SEQ ID NO: 33135 - DNA, 20 bp, Artificial Sequence
  Description of Artificial Sequence: Synthetic oligonucleotide
  Target: ATXN1; (+) strand; PAM type: NNNNGHTT; PAM sequence: ATTTGATT
ctcattatgggaatcattac

SEQ ID NO: 33136 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
gccagccttgactgagggtc

SEQ ID NO: 33137 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
gtcttctgattctaaatggt

SEQ ID NO: 33138 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
tgtcaggaatcattctctga

SEQ ID NO: 33139 - DNA, 20 bp, Artificial Sequence
  Description of Artificial Sequence: Synthetic oligonucleotide
  Target: ATXN1; (+) strand; PAM type: NNNNGHTT; PAM sequence: GTGTGATT
tggccatatgaaaacatgtt

SEQ ID NO: 33140 - DNA, 20 bp, Artificial Sequence
  Description of Artificial Sequence: Synthetic oligonucleotide
  Target: ATXN1; (+) strand; PAM type: NNNNGHTT; PAM sequence: TGGAGCTT
actggtgttcatgtaactgc

SEQ ID NO: 33141 - DNA, 20 bp, Artificial Sequence
  Description of Artificial Sequence: Synthetic oligonucleotide
  Target: ATXN1; (+) strand; PAM type: NNNNGHTT; PAM sequence: GCTTGCTT
gtgttcatgtaactgctgga

SEQ ID NO: 33142 - DNA, 20 bp, Artificial Sequence
  Description of Artificial Sequence: Synthetic oligonucleotide
  Target: ATXN1; (+) strand; PAM type: NNNNGHTT; PAM sequence: GATGGCTT
gctcttgatctgactggacg

SEQ ID NO: 33143 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
ttggagaccaggctctgaag

SEQ ID NO: 33144 - DNA, 20 bp, Artificial Sequence
  Description of Artificial Sequence: Synthetic oligonucleotide
  Target: ATXN1; (+) strand; PAM type: NNNNGHTT; PAM sequence: TGGAGCTT
aagagatgcttgtaaaaatc

SEQ ID NO: 33145 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
aaaatctggagcttaacaca

SEQ ID NO: 33146 - DNA, 20 bp, Artificial Sequence
  Description of Artificial Sequence: Synthetic oligonucleotide
  Target: ATXN1; (+) strand; PAM type: NNNNGHTT; PAM sequence: TGGAGCTT
caagaagctcctttaagtgt

SEQ ID NO: 33147 - DNA, 20 bp, Artificial Sequence
  Description of Artificial Sequence: Synthetic oligonucleotide
  Target: ATXN1; (+) strand; PAM type: NNNNGHTT; PAM sequence: GGGAGATT
acgttacccatttcagagca

SEQ ID NO: 33148 - DNA, 20 bp, Artificial Sequence
  Description of Artificial Sequence: Synthetic oligonucleotide
  Target: ATXN1; (+) strand; PAM type: NNNNGHTT; PAM sequence: GTCGGCTT
tccagagaagtcacctgggt

SEQ ID NO: 33149 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
gagagacactttcggagcct

SEQ ID NO: 33150 - DNA, 20 bp, Artificial Sequence
  Description of Artificial Sequence: Synthetic oligonucleotide
  Target: ATXN1; (+) strand; PAM type: NNNNGHTT; PAM sequence: TCTTGCTT
atataatgtgaacatcttgc

SEQ ID NO: 33151 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
ctattcatatagatgtgata

SEQ ID NO: 33152 - DNA, 20 bp, Artificial Sequence
  Description of Artificial Sequence: Synthetic oligonucleotide
  Target: ATXN1; (+) strand; PAM type: NNNNGHTT; PAM sequence: ATAGGTTT
atgtgatattcagtttatgt

SEQ ID NO: 33153 - DNA, 20 bp, Artificial Sequence
  Description of Artificial Sequence: Synthetic oligonucleotide
  Target: ATXN1; (+) strand; PAM type: NNNNGHTT; PAM sequence: TAGGGCTT
acaaagcactttcagtctgc

SEQ ID NO: 33154 - DNA, 20 bp, Artificial Sequence
  Description of Artificial Sequence: Synthetic oligonucleotide
  Target: ATXN1; (+) strand; PAM type: NNNNGHTT; PAM sequence: AGGTGCTT
tgataccatctaattaaatg

SEQ ID NO: 33155 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
ccaacagactttttctggaa

SEQ ID NO: 33156 - DNA, 20 bp, Artificial Sequence
  Description of Artificial Sequence: Synthetic oligonucleotide
  Target: ATXN1; (+) strand; PAM type: NNNNGHTT; PAM sequence: GATTGCTT
cagactttttctggaaaaat

SEQ ID NO: 33157 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
ctacatgtcagttggctgtt

SEQ ID NO: 33158 - DNA, 20 bp, Artificial Sequence
  Description of Artificial Sequence: Synthetic oligonucleotide
  Target: ATXN1; (+) strand; PAM type: NNNNGHTT; PAM sequence: CTATGTTT
aagctctctgagagcaagaa

SEQ ID NO: 33159 - DNA, 20 bp, Artificial Sequence
  Description of Artificial Sequence: Synthetic oligonucleotide
  Target: ATXN1; (+) strand; PAM type: NNNNGHTT; PAM sequence: CATTGATT
aaggacaaaacaaaattgat

SEQ ID NO: 33160 - DNA, 20 bp, Artificial Sequence
  Description of Artificial Sequence: Synthetic oligonucleotide
  Target: ATXN1; (+) strand; PAM type: NNNNGHTT; PAM sequence: CAAAGTTT
aatctaaccaaagaacaagg

SEQ ID NO: 33161 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
aagcatagaatgagttccct

SEQ ID NO: 33162 - DNA, 20 bp, Artificial Sequence
  Description of Artificial Sequence: Synthetic oligonucleotide
  Target: ATXN1; (+) strand; PAM type: NNNNGHTT; PAM sequence: TACCGTTT
gggggcatggctcccacccg

SEQ ID NO: 33163 - DNA, 20 bp, Artificial Sequence
  Description of Artificial Sequence: Synthetic oligonucleotide
  Target: ATXN1; (+) strand; PAM type: NNNNGHTT; PAM sequence: AGTTGATT
cacccgtaccgtttaaaact

SEQ ID NO: 33164 - DNA, 20 bp, Artificial Sequence
  Description of Artificial Sequence: Synthetic oligonucleotide
  Target: ATXN1; (+) strand; PAM type: NNNNGHTT; PAM sequence: TACGGATT
tccccctctcagcaatctat

SEQ ID NO: 33165 - DNA, 20 bp, Artificial Sequence
  Description of Artificial Sequence: Synthetic oligonucleotide
  Target: ATXN1; (+) strand; PAM type: NNNNGHTT; PAM sequence: ATTTGTTT
ctctcagcaatctattacgg

SEQ ID NO: 33166 - DNA, 20 bp, Artificial Sequence
  Description of Artificial Sequence: Synthetic oligonucleotide
  Target: ATXN1; (+) strand; PAM type: NNNNGHTT; PAM sequence: TTTCGTTT
caggagtgagttagtaagca

SEQ ID NO: 33167 - DNA, 20 bp, Artificial Sequence
  Description of Artificial Sequence: Synthetic oligonucleotide
  Target: ATXN1; (+) strand; PAM type: NNNNGHTT; PAM sequence: AGATGATT
ttcatccccagtaaagggta

SEQ ID NO: 33168 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
ccatgttccgctggctctag

SEQ ID NO: 33169 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
tccgctggctctagaaatga

SEQ ID NO: 33170 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
aaggtattttggcagcaggt

SEQ ID NO: 33171 - DNA, 20 bp, Artificial Sequence
  Description of Artificial Sequence: Synthetic oligonucleotide
  Target: ATXN1; (+) strand; PAM type: NNNNGHTT; PAM sequence: AGTCGCTT
tcattaagttcaagagctgg

SEQ ID NO: 33172 - DNA, 20 bp, Artificial Sequence
  Description of Artificial Sequence: Synthetic oligonucleotide
  Target: ATXN1; (+) strand; PAM type: NNNNGHTT; PAM sequence: CTCTGATT
cagtaaagctggagtcagaa

SEQ ID NO: 33173 - DNA, 20 bp, Artificial Sequence
  Description of Artificial Sequence: Synthetic oligonucleotide
  Target: ATXN1; (+) strand; PAM type: NNNNGHTT; PAM sequence: AATGGCTT
gtatagggcaccattttaaa

SEQ ID NO: 33174 - DNA, 20 bp, Artificial Sequence
  Description of Artificial Sequence: Synthetic oligonucleotide
  Target: ATXN1; (+) strand; PAM type: NNNNGHTT; PAM sequence: TCTAGATT
aaatggcttcatgctgaggt

SEQ ID NO: 33175 - DNA, 20 bp, Artificial Sequence
  Description of Artificial Sequence: Synthetic oligonucleotide
  Target: ATXN1; (+) strand; PAM type: NNNNGHTT; PAM sequence: TAGGGTTT
ttttgtatttttagtagaga

SEQ ID NO: 33176 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cgcctcagcctcccaatgtg

SEQ ID NO: 33177 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
ttcccctactgctcaaggat

SEQ ID NO: 33178 - DNA, 20 bp, Artificial Sequence
  Description of Artificial Sequence: Synthetic oligonucleotide
  Target: ATXN1; (+) strand; PAM type: NNNNGHTT; PAM sequence: TTCAGATT
actgttcagggatccactcg

SEQ ID NO: 33179 - DNA, 20 bp, Artificial Sequence
  Description of Artificial Sequence: Synthetic oligonucleotide
  Target: ATXN1; (+) strand; PAM type: NNNNGHTT; PAM sequence: AGGAGCTT
ttggtgccttgtctccttca

SEQ ID NO: 33180 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
tgtgacacctcaatcagcac

SEQ ID NO: 33181 - DNA, 20 bp, Artificial Sequence
  Description of Artificial Sequence: Synthetic oligonucleotide
  Target: ATXN1; (+) strand; PAM type: NNNNGHTT; PAM sequence: GCACGTTT
agggtacatatgcacaatgt

SEQ ID NO: 33182 - DNA, 20 bp, Artificial Sequence
  Description of Artificial Sequence: Synthetic oligonucleotide
  Target: ATXN1; (+) strand; PAM type: NNNNGHTT; PAM sequence: ACCGGTTT
aggagttccaaaacagaatt

SEQ ID NO: 33183 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
ctggagtgcagtggtgcaac

SEQ ID NO: 33184 - DNA, 20 bp, Artificial Sequence
  Description of Artificial Sequence: Synthetic oligonucleotide
  Target: ATXN1; (+) strand; PAM type: NNNNGHTT; PAM sequence: AAGTGATT
aacctctgcctcccaagttc

SEQ ID NO: 33185 - DNA, 20 bp, Artificial Sequence
  Description of Artificial Sequence: Synthetic oligonucleotide
  Target: ATXN1; (+) strand; PAM type: NNNNGHTT; PAM sequence: TGGGGTTT
ttttgtatttttagtagaga

SEQ ID NO: 33186 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
cacattggcctcccaaagtg

SEQ ID NO: 33187 - DNA, 20 bp, Artificial Sequence
  Description of Artificial Sequence: Synthetic oligonucleotide
  Target: ATXN1; (+) strand; PAM type: NNNNGHTT; PAM sequence: ATTGGTTT
ccactgcgcctggccgaatt

SEQ ID NO: 33188 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
ggccgaattattggttttca

SEQ ID NO: 33189 - DNA, 20 bp, Artificial Sequence
  Description of Artificial Sequence: Synthetic oligonucleotide
  Target: ATXN1; (+) strand; PAM type: NNNNGHTT; PAM sequence: GGGGGCTT
agaacattcaaatgacattt

SEQ ID NO: 33190 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
catttgggggcttaacaccc

SEQ ID NO: 33191 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
gaaacattattttacttttc

SEQ ID NO: 33192 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
aagggtgcattcagtcccaa

SEQ ID NO: 33193 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
gtcccaaaactgtttacaag

SEQ ID NO: 33194 - DNA, 20 bp, Artificial Sequence
  Description of Artificial Sequence: Synthetic oligonucleotide
  Target: ATXN1; (+) strand; PAM type: NNNNGHTT; PAM sequence: TTCTGCTT
tctactattgtaaaattttt

SEQ ID NO: 33195 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
ctgcttacttcttttttccc

SEQ ID NO: 33196 - DNA, 20 bp, Artificial Sequence
  Description of Artificial Sequence: Synthetic oligonucleotide
  Target: ATXN1; (+) strand; PAM type: NNNNGHTT; PAM sequence: CAGAGATT
ttctgatctcttctcagcat

SEQ ID NO: 33197 - DNA, 20 bp, Artificial Sequence
  Description of Artificial Sequence: Synthetic oligonucleotide
  Target: ATXN1; (+) strand; PAM type: NNNNGHTT; PAM sequence: TTATGTTT
tctcttctcagcatcagaga

SEQ ID NO: 33198 - DNA, 20 bp, Artificial Sequence
  Description of Artificial Sequence: Synthetic oligonucleotide
  Target: ATXN1; (+) strand; PAM type: NNNNGHTT; PAM sequence: GGATGTTT
atctttaaagaaacaatctt

SEQ ID NO: 33199 - DNA, 20 bp, Artificial Sequence
  Description of Artificial Sequence: Synthetic oligonucleotide
  Target: ATXN1; (+) strand; PAM type: NNNNGHTT; PAM sequence: TGAGGCTT
tgtttaccttttcttaccta

SEQ ID NO: 33200 - DNA, 20 bp, Artificial Sequence
  Description of Artificial Sequence: Synthetic oligonucleotide
  Target: ATXN1; (+) strand; PAM type: NNNNGHTT; PAM sequence: GCAAGTTT
tggaaaaggggacctctatg

SEQ ID NO: 33201 - DNA, 20 bp, Artificial Sequence
  Description of Artificial Sequence: Synthetic oligonucleotide
  Target: ATXN1; (+) strand; PAM type: NNNNGHTT; PAM sequence: GTCTGCTT
tatggcaagtttcatgacag

SEQ ID NO: 33202 - DNA, 20 bp, Artificial Sequence
  Description of Artificial Sequence: Synthetic oligonucleotide
  Target: ATXN1; (+) strand; PAM type: NNNNGHTT; PAM sequence: CTTGGATT
agaatataacaaaagggcct

SEQ ID NO: 33203 - DNA, 20 bp, Artificial Sequence
  Description of Artificial Sequence: Synthetic oligonucleotide
  Target: ATXN1; (+) strand; PAM type: NNNNGHTT; PAM sequence: CCTGGTTT
ctgacccagaatattaaagt

SEQ ID NO: 33204 - DNA, 20 bp, Artificial Sequence
  Description of Artificial Sequence: Synthetic oligonucleotide
  Target: ATXN1; (+) strand; PAM type: NNNNGHTT; PAM sequence: TGTAGCTT
tagagcccaaactggagatc

SEQ ID NO: 33205 - DNA, 20 bp, Artificial Sequence
  Description of Artificial Sequence: Synthetic oligonucleotide
  Target: ATXN1; (+) strand; PAM type: NNNNGHTT; PAM sequence: GGAAGTTT
tgtctctcaattaccctggg

SEQ ID NO: 33206 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
agttataaattgctaagtta

SEQ ID NO: 33207 - DNA, 20 bp, Artificial Sequence
  Description of Artificial Sequence: Synthetic oligonucleotide
  Target: ATXN1; (+) strand; PAM type: NNNNGHTT; PAM sequence: CCAAGATT
atattcagcacatcttgcag

SEQ ID NO: 33208 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
agcacatcttgcagccaaga

SEQ ID NO: 33209 - DNA, 20 bp, Artificial Sequence
  Description of Artificial Sequence: Synthetic oligonucleotide
  Target: ATXN1; (+) strand; PAM type: NNNNGHTT; PAM sequence: TAAAGATT
agacacacacacaatcagtg

SEQ ID NO: 33210 - DNA, 20 bp, Artificial Sequence
  Description of Artificial Sequence: Synthetic oligonucleotide
  Target: ATXN1; (+) strand; PAM type: NNNNGHTT; PAM sequence: GTCTGATT
gaaggctcacagttgaagtt

SEQ ID NO: 33211 - DNA, 20 bp, Artificial Sequence
  Description of Artificial Sequence: Synthetic oligonucleotide
  Target: ATXN1; (+) strand; PAM type: NNNNGHTT; PAM sequence: ACTCGATT
cacacccagcacacattcag

SEQ ID NO: 33212 - DNA, 20 bp, Artificial Sequence
  Description of Artificial Sequence: Synthetic oligonucleotide
  Target: ATXN1; (+) strand; PAM type: NNNNGHTT; PAM sequence: CACGGCTT
ttttcccagaaacatgcgat

SEQ ID NO: 33213 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
gctcaaaacctgtggataat

SEQ ID NO: 33214 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
ttttccttagaagtagaaac

SEQ ID NO: 33215 - DNA, 20 bp, Artificial Sequence
  Description of Artificial Sequence: Synthetic oligonucleotide
  Target: ATXN1; (+) strand; PAM type: NNNNGHTT; PAM sequence: TTCTGCTT
gtccttcgtctcttcctcct

SEQ ID NO: 33216 - DNA, 20 bp, Artificial Sequence
  Description of Artificial Sequence: Synthetic oligonucleotide
  Target: ATXN1; (+) strand; PAM type: NNNNGHTT; PAM sequence: ACCAGCTT
cttgaggtcaggagttcgag

SEQ ID NO: 33217 - DNA, 20 bp, Artificial Sequence
  Description of Artificial Sequence: Synthetic oligonucleotide
  Target: ATXN1; (+) strand; PAM type: NNNNGHTT; PAM sequence: CAATGTTT
atggcagaatagaaaggtga

SEQ ID NO: 33218 - DNA, 20 bp, Artificial Sequence
  Description of Artificial Sequence: Synthetic oligonucleotide
  Target: ATXN1; (+) strand; PAM type: NNNNGHTT; PAM sequence: GACTGCTT
cagtgaccataatcaccctg

SEQ ID NO: 33219 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
gaaaaataaatgtctatttc

SEQ ID NO: 33220 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
ggtcataatagacttcattt

SEQ ID NO: 33221 - DNA, 20 bp, Artificial Sequence
  Description of Artificial Sequence: Synthetic oligonucleotide
  Target: ATXN1; (+) strand; PAM type: NNNNGHTT; PAM sequence: TAATGATT
cattttacagattaggaaac

SEQ ID NO: 33222 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
agttggcaaattaattacac

SEQ ID NO: 33223 - DNA, 20 bp, Artificial Sequence
  Description of Artificial Sequence: Synthetic oligonucleotide
  Target: ATXN1; (+) strand; PAM type: NNNNGHTT; PAM sequence: TACGGTTT
atcagtatctgctaaatgaa

SEQ ID NO: 33224 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
tttcttttcctgctatgttc

SEQ ID NO: 33225 - DNA, 20 bp, Artificial Sequence
  Description of Artificial Sequence: Synthetic oligonucleotide
  Target: ATXN1; (+) strand; PAM type: NNNNGHTT; PAM sequence: TGGAGATT
gtattttagaaagtgctaaa

SEQ ID NO: 33226 - DNA, 20 bp, Artificial Sequence
  Description of Artificial Sequence: Synthetic oligonucleotide
  Target: ATXN1; (+) strand; PAM type: NNNNGHTT; PAM sequence: GGATGCTT
tagctgtaaaatatatccct

SEQ ID NO: 33227 - DNA, 20 bp, Artificial Sequence
  Description of Artificial Sequence: Synthetic oligonucleotide
  Target: ATXN1; (+) strand; PAM type: NNNNGHTT; PAM sequence: TGTTGCTT
gtcttctaaaactcctctct

SEQ ID NO: 33228 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
tcctggaggaatgggcagta

SEQ ID NO: 33229 - DNA, 20 bp, Artificial Sequence
  Description of Artificial Sequence: Synthetic oligonucleotide
  Target: ATXN1; (+) strand; PAM type: NNNNGHTT; PAM sequence: GCTAGCTT
tatccaacatctacttaaat

SEQ ID NO: 33230 - DNA, 20 bp, Artificial Sequence
  Description of Artificial Sequence: Synthetic oligonucleotide
  Target: ATXN1; (+) strand; PAM type: NNNNGHTT; PAM sequence: ATGAGTTT
gggactatttgccttgaaaa

SEQ ID NO: 33231 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
taccatttttgaaatggaaa

SEQ ID NO: 33232 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
ccgacagagcctggcagggc

SEQ ID NO: 33233 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
cggacatatttcaaaaatgc

SEQ ID NO: 33234 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
gtaatcaaagatctaaaagc

SEQ ID NO: 33235 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
caaagaactgaagctactaa

SEQ ID NO: 33236 - DNA, 20 bp, Artificial Sequence
  Description of Artificial Sequence: Synthetic oligonucleotide
  Target: ATXN1; (+) strand; PAM type: NNNNGHTT; PAM sequence: ACACGATT
gtcgtgaaagaaactggcaa

SEQ ID NO: 33237 - DNA, 20 bp, Artificial Sequence
  Description of Artificial Sequence: Synthetic oligonucleotide
  Target: ATXN1; (+) strand; PAM type: NNNNGHTT; PAM sequence: TTGTGTTT
gtgacagaagaaataaaaac

SEQ ID NO: 33238 - DNA, 20 bp, Artificial Sequence
  Description of Artificial Sequence: Synthetic oligonucleotide
  Target: ATXN1; (+) strand; PAM type: NNNNGHTT; PAM sequence: GATAGCTT
aatgtacaatgcacaactaa

SEQ ID NO: 33239 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
tgatatatccactatttaca

SEQ ID NO: 33240 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
taaagctcacatatatctat

SEQ ID NO: 33241 - DNA, 20 bp, Artificial Sequence
  Description of Artificial Sequence: Synthetic oligonucleotide
  Target: ATXN1; (+) strand; PAM type: NNNNGHTT; PAM sequence: ACTAGTTT
tattgtaactagaattataa

SEQ ID NO: 33242 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
aagccagaaaaaccttaaac

SEQ ID NO: 33243 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
ttccagtagagatgggctca

SEQ ID NO: 33244 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
caactagaatggtgtgaaag

SEQ ID NO: 33245 - DNA, 20 bp, Artificial Sequence
  Description of Artificial Sequence: Synthetic oligonucleotide
  Target: ATXN1; (+) strand; PAM type: NNNNGHTT; PAM sequence: AACTGTTT
ttaatttacttacaagaagg

SEQ ID NO: 33246 - DNA, 20 bp, Artificial Sequence
  Description of Artificial Sequence: Synthetic oligonucleotide
  Target: ATXN1; (+) strand; PAM type: NNNNGHTT; PAM sequence: ATTGGTTT
tacaagaaggaactgtttta

SEQ ID NO: 33247 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
tagttacaattttttttttt

SEQ ID NO: 33248 - DNA, 20 bp, Artificial Sequence
  Description of Artificial Sequence: Synthetic oligonucleotide
  Target: ATXN1; (+) strand; PAM type: NNNNGHTT; PAM sequence: TGAGGATT
tctccaagcatgtgaatgag

SEQ ID NO: 33249 - DNA, 20 bp, Artificial Sequence
  Description of Artificial Sequence: Synthetic oligonucleotide
  Target: ATXN1; (+) strand; PAM type: NNNNGHTT; PAM sequence: ACAGGTTT
tgcaaaaacttaggatcttt

SEQ ID NO: 33250 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
tatttgacctgaattgatac

SEQ ID NO: 33251 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
ggctcaagtgatcctcccat

SEQ ID NO: 33252 - DNA, 20 bp, Artificial Sequence
  Description of Artificial Sequence: Synthetic oligonucleotide
  Target: ATXN1; (+) strand; PAM type: NNNNGHTT; PAM sequence: TAGAGATT
tttatttttatttttttcag

SEQ ID NO: 33253 - DNA, 20 bp, Artificial Sequence
  Description of Artificial Sequence: Synthetic oligonucleotide
  Target: ATXN1; (+) strand; PAM type: NNNNGHTT; PAM sequence: AGGTGTTT
ccaccatgcccagcccatac

SEQ ID NO: 33254 - DNA, 20 bp, Artificial Sequence
  Description of Artificial Sequence: Synthetic oligonucleotide
  Target: ATXN1; (+) strand; PAM type: NNNNGHTT; PAM sequence: TTTGGTTT
agcccatacaggtgttttaa

SEQ ID NO: 33255 - DNA, 20 bp, Artificial Sequence
  Description of Artificial Sequence: Synthetic oligonucleotide
  Target: ATXN1; (+) strand; PAM type: NNNNGHTT; PAM sequence: GTGTGATT
ttattgtaaaatttctttat

SEQ ID NO: 33256 - DNA, 20 bp, Artificial Sequence
  Description of Artificial Sequence: Synthetic oligonucleotide
  Target: ATXN1; (+) strand; PAM type: NNNNGHTT; PAM sequence: AATTGCTT
ttgttgatacacatttttaa

SEQ ID NO: 33257 - DNA, 20 bp, Artificial Sequence
  Description of Artificial Sequence: Synthetic oligonucleotide
  Target: ATXN1; (+) strand; PAM type: NNNNGHTT; PAM sequence: AGGAGATT
catctcagtaaatgccaaga

SEQ ID NO: 33258 - DNA, 20 bp, Artificial Sequence
  Description of Artificial Sequence: Synthetic oligonucleotide
  Target: ATXN1; (+) strand; PAM type: NNNNGHTT; PAM sequence: AATGGATT
aaccatgcccatttggataa

SEQ ID NO: 33259 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
cagaaggatcacttgagccc

SEQ ID NO: 33260 - DNA, 20 bp, Artificial Sequence
  Description of Artificial Sequence: Synthetic oligonucleotide
  Target: ATXN1; (+) strand; PAM type: NNNNGHTT; PAM sequence: CTGTGATT
gagacagaggctatagggag

SEQ ID NO: 33261 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
agagtagagaatgtagagac

SEQ ID NO: 33262 - DNA, 20 bp, Artificial Sequence
  Description of Artificial Sequence: Synthetic oligonucleotide
  Target: ATXN1; (+) strand; PAM type: NNNNGHTT; PAM sequence: GGAGGTTT
tgtcctgttaactccatgga

SEQ ID NO: 33263 - DNA, 20 bp, Artificial Sequence
  Description of Artificial Sequence: Synthetic oligonucleotide
  Target: ATXN1; (+) strand; PAM type: NNNNGHTT; PAM sequence: CATTGATT
aaccatcagttgtattctta

SEQ ID NO: 33264 - DNA, 20 bp, Artificial Sequence
  Description of Artificial Sequence: Synthetic oligonucleotide
  Target: ATXN1; (+) strand; PAM type: NNNNGHTT; PAM sequence: TATGGTTT
cattgattatggttcaatgg

SEQ ID NO: 33265 - DNA, 20 bp, Artificial Sequence
  Description of Artificial Sequence: Synthetic oligonucleotide
  Target: ATXN1; (+) strand; PAM type: NNNNGHTT; PAM sequence: TCTTGTTT
tttagaaatgatccataatt

SEQ ID NO: 33266 - DNA, 20 bp, Artificial Sequence
  Description of Artificial Sequence: Synthetic oligonucleotide
  Target: ATXN1; (+) strand; PAM type: NNNNGHTT; PAM sequence: CTTAGTTT
ccataatttcttgtttgggt

SEQ ID NO: 33267 - DNA, 20 bp, Artificial Sequence
  Description of Artificial Sequence: Synthetic oligonucleotide
  Target: ATXN1; (+) strand; PAM type: NNNNGHTT; PAM sequence: ATCTGCTT
ttttacttattttattttct

SEQ ID NO: 33268 - DNA, 20 bp, Artificial Sequence
  Description of Artificial Sequence: Synthetic oligonucleotide
  Target: ATXN1; (+) strand; PAM type: NNNNGHTT; PAM sequence: TATAGTTT
ctgatcaggttagggcatga

SEQ ID NO: 33269 - DNA, 20 bp, Artificial Sequence
  Description of Artificial Sequence: Synthetic oligonucleotide
  Target: ATXN1; (+) strand; PAM type: NNNNGHTT; PAM sequence: GGCAGTTT
ggagacaactgaataatggg

SEQ ID NO: 33270 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
tagtgaataagtctcacgag

SEQ ID NO: 33271 - DNA, 20 bp, Artificial Sequence
  Description of Artificial Sequence: Synthetic oligonucleotide
  Target: ATXN1; (+) strand; PAM type: NNNNGHTT; PAM sequence: GATTGTTT
gaataagtctcacgagatct

SEQ ID NO: 33272 - DNA, 20 bp, Artificial Sequence
  Description of Artificial Sequence: Synthetic oligonucleotide
  Target: ATXN1; (+) strand; PAM type: NNNNGHTT; PAM sequence: AGAGGTTT
cgagatctgattgttttata

SEQ ID NO: 33273 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
gttttataagaggtttcccc

SEQ ID NO: 33274 - DNA, 20 bp, Artificial Sequence
  Description of Artificial Sequence: Synthetic oligonucleotide
  Target: ATXN1; (+) strand; PAM type: NNNNGHTT; PAM sequence: CCATGATT
gacatgccttttgccttcca

SEQ ID NO: 33275 - DNA, 20 bp, Artificial Sequence
  Description of Artificial Sequence: Synthetic oligonucleotide
  Target: ATXN1; (+) strand; PAM type: NNNNGHTT; PAM sequence: CTAGGCTT
tctttttctttataaattac

SEQ ID NO: 33276 - DNA, 20 bp, Artificial Sequence
  Description of Artificial Sequence: Synthetic oligonucleotide
  Target: ATXN1; (+) strand; PAM type: NNNNGHTT; PAM sequence: ACCTGTTT
gggcatcacacccaaattag

SEQ ID NO: 33277 - DNA, 20 bp, Artificial Sequence
  Description of Artificial Sequence: Synthetic oligonucleotide
  Target: ATXN1; (+) strand; PAM type: NNNNGHTT; PAM sequence: TAATGCTT
ctacttccatatgaactctg

SEQ ID NO: 33278 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
tatatacctcgaattatacc

SEQ ID NO: 33279 - DNA, 20 bp, Artificial Sequence
  Description of Artificial Sequence: Synthetic oligonucleotide
  Target: ATXN1; (+) strand; PAM type: NNNNGHTT; PAM sequence: TCCAGCTT
tgctaaaaaggaacttacaa

SEQ ID NO: 33280 - DNA, 20 bp, Artificial Sequence
  Description of Artificial Sequence: Synthetic oligonucleotide
  Target: ATXN1; (+) strand; PAM type: NNNNGHTT; PAM sequence: GCTCGATT
gtgcaaaaattgaaaagtat

SEQ ID NO: 33281 - DNA, 20 bp, Artificial Sequence
  Description of Artificial Sequence: Synthetic oligonucleotide
  Target: ATXN1; (+) strand; PAM type: NNNNGHTT; PAM sequence: GAGGGTTT
tatgctcgattagcaagcta

SEQ ID NO: 33282 - DNA, 20 bp, Artificial Sequence
  Description of Artificial Sequence: Synthetic oligonucleotide
  Target: ATXN1; (+) strand; PAM type: NNNNGHTT; PAM sequence: AGTAGCTT
gagggtttattagaaataac

SEQ ID NO: 33283 - DNA, 20 bp, Artificial Sequence
  Description of Artificial Sequence: Synthetic oligonucleotide
  Target: ATXN1; (+) strand; PAM type: NNNNGHTT; PAM sequence: CATAGTTT
aacttccctactataaaaac

SEQ ID NO: 33284 - DNA, 20 bp, Artificial Sequence
  Description of Artificial Sequence: Synthetic oligonucleotide
  Target: ATXN1; (+) strand; PAM type: NNNNGHTT; PAM sequence: GCCTGCTT
ctataaaaaccatagtttaa

SEQ ID NO: 33285 - DNA, 20 bp, Artificial Sequence
  Description of Artificial Sequence: Synthetic oligonucleotide
  Target: ATXN1; (+) strand; PAM type: NNNNGHTT; PAM sequence: TCTGGTTT
aagcctgctttaacattaga

SEQ ID NO: 33286 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
cattagatctggtttcccac

SEQ ID NO: 33287 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
ccacaactgattaacctgaa

SEQ ID NO: 33288 - DNA, 20 bp, Artificial Sequence
  Description of Artificial Sequence: Synthetic oligonucleotide
  Target: ATXN1; (+) strand; PAM type: NNNNGHTT; PAM sequence: CTTGGATT
caagttccacagagcccttt

SEQ ID NO: 33289 - DNA, 20 bp, Artificial Sequence
  Description of Artificial Sequence: Synthetic oligonucleotide
  Target: ATXN1; (+) strand; PAM type: NNNNGHTT; PAM sequence: TGAGGTTT
aaggacacctgtgagcatcg

SEQ ID NO: 33290 - DNA, 20 bp, Artificial Sequence
  Description of Artificial Sequence: Synthetic oligonucleotide
  Target: ATXN1; (+) strand; PAM type: NNNNGHTT; PAM sequence: TACAGTTT
gagttacctgcacgcattct

SEQ ID NO: 33291 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
ctgctaacttcccttcagaa

SEQ ID NO: 33292 - DNA, 20 bp, Artificial Sequence
  Description of Artificial Sequence: Synthetic oligonucleotide
  Target: ATXN1; (+) strand; PAM type: NNNNGHTT; PAM sequence: AGCAGCTT
cccactcacccacctacccc

SEQ ID NO: 33293 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
ctggcatgatcaggaaggca

SEQ ID NO: 33294 - DNA, 20 bp, Artificial Sequence
  Description of Artificial Sequence: Synthetic oligonucleotide
  Target: ATXN1; (+) strand; PAM type: NNNNGHTT; PAM sequence: CCAAGCTT
tgaaaaggatatattattgc

SEQ ID NO: 33295 - DNA, 20 bp, Artificial Sequence
  Description of Artificial Sequence: Synthetic oligonucleotide
  Target: ATXN1; (+) strand; PAM type: NNNNGHTT; PAM sequence: CACTGATT
ttattgcccaagcttaactt

SEQ ID NO: 33296 - DNA, 20 bp, Artificial Sequence
  Description of Artificial Sequence: Synthetic oligonucleotide
  Target: ATXN1; (+) strand; PAM type: NNNNGHTT; PAM sequence: CAAAGATT
tgtccttctatgcctggtta

SEQ ID NO: 33297 - DNA, 20 bp, Artificial Sequence
  Description of Artificial Sequence: Synthetic oligonucleotide
  Target: ATXN1; (+) strand; PAM type: NNNNGHTT; PAM sequence: AGTAGTTT
tctctcaccctgataatcac

SEQ ID NO: 33298 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
ggataatttccatcagacca

SEQ ID NO: 33299 - DNA, 20 bp, Artificial Sequence
  Description of Artificial Sequence: Synthetic oligonucleotide
  Target: ATXN1; (+) strand; PAM type: NNNNGHTT; PAM sequence: CCTAGATT
aatttagctctgtgtgccca

SEQ ID NO: 33300 - DNA, 20 bp, Artificial Sequence
  Description of Artificial Sequence: Synthetic oligonucleotide
  Target: ATXN1; (+) strand; PAM type: NNNNGHTT; PAM sequence: ATTTGCTT
gaattgaaatagtccaagct

SEQ ID NO: 33301 - DNA, 20 bp, Artificial Sequence
  Description of Artificial Sequence: Synthetic oligonucleotide
  Target: ATXN1; (+) strand; PAM type: NNNNGHTT; PAM sequence: AGGTGTTT
gaatgaaaggcctatggcca

SEQ ID NO: 33302 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
ggactatctgttcaattacc

SEQ ID NO: 33303 - DNA, 20 bp, Artificial Sequence
  Description of Artificial Sequence: Synthetic oligonucleotide
  Target: ATXN1; (+) strand; PAM type: NNNNGHTT; PAM sequence: CTGGGCTT
aattacctacagatttccca

SEQ ID NO: 33304 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
acactaatagcacacttatt

SEQ ID NO: 33305 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
cctacaaaagggaaaaatgt

SEQ ID NO: 33306 - DNA, 20 bp, Artificial Sequence
  Description of Artificial Sequence: Synthetic oligonucleotide
  Target: ATXN1; (+) strand; PAM type: NNNNGHTT; PAM sequence: TCATGCTT
tggcaagatacgatcaattt

SEQ ID NO: 33307 - DNA, 20 bp, Artificial Sequence
  Description of Artificial Sequence: Synthetic oligonucleotide
  Target: ATXN1; (+) strand; PAM type: NNNNGHTT; PAM sequence: TGGGGATT
caatgctcacttggggtgtg

SEQ ID NO: 33308 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
tctaggtggagttgttatca

SEQ ID NO: 33309 - DNA, 20 bp, Artificial Sequence
  Description of Artificial Sequence: Synthetic oligonucleotide
  Target: ATXN1; (+) strand; PAM type: NNNNGHTT; PAM sequence: TGTAGCTT
tttcacaaatttgaagggac

SEQ ID NO: 33310 - DNA, 20 bp, Artificial Sequence
  Description of Artificial Sequence: Synthetic oligonucleotide
  Target: ATXN1; (+) strand; PAM type: NNNNGHTT; PAM sequence: GGTGGATT
gcctgtggaggtgggaaaat

SEQ ID NO: 33311 - DNA, 20 bp, Artificial Sequence
  Description of Artificial Sequence: Synthetic oligonucleotide
  Target: ATXN1; (+) strand; PAM type: NNNNGHTT; PAM sequence: TCCCGCTT
agaggcaaattatgtcacct

SEQ ID NO: 33312 - DNA, 20 bp, Artificial Sequence
  Description of Artificial Sequence: Synthetic oligonucleotide
  Target: ATXN1; (+) strand; PAM type: NNNNGHTT; PAM sequence: TACAGCTT
tttccttttcatttaaaatc

SEQ ID NO: 33313 - DNA, 20 bp, Artificial Sequence
  Description of Artificial Sequence: Synthetic oligonucleotide
  Target: ATXN1; (+) strand; PAM type: NNNNGHTT; PAM sequence: TCTAGCTT
aacctgcaggaacctagcaa

SEQ ID NO: 33314 - DNA, 20 bp, Artificial Sequence
  Description of Artificial Sequence: Synthetic oligonucleotide
  Target: ATXN1; (+) strand; PAM type: NNNNGHTT; PAM sequence: AATGGTTT
acctagcaatctagcttcaa

SEQ ID NO: 33315 - DNA, 20 bp, Artificial Sequence
  Description of Artificial Sequence: Synthetic oligonucleotide
  Target: ATXN1; (+) strand; PAM type: NNNNGHTT; PAM sequence: ATGGGATT
actttcagtatccctcatat

SEQ ID NO: 33316 - DNA, 20 bp, Artificial Sequence
  Description of Artificial Sequence: Synthetic oligonucleotide
  Target: ATXN1; (+) strand; PAM type: NNNNGHTT; PAM sequence: TGTTGTTT
cactgtgagaaatgtatttc

SEQ ID NO: 33317 - DNA, 20 bp, Artificial Sequence
  Description of Artificial Sequence: Synthetic oligonucleotide
  Target: ATXN1; (+) strand; PAM type: NNNNGHTT; PAM sequence: ATAAGTTT
gaaatgtatttctgttgttt

SEQ ID NO: 33318 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
ttgtttataagtttacggta

SEQ ID NO: 33319 - DNA, 20 bp, Artificial Sequence
  Description of Artificial Sequence: Synthetic oligonucleotide
  Target: ATXN1; (+) strand; PAM type: NNNNGHTT; PAM sequence: AAAAGTTT
tacatccacctcaaaggaag

SEQ ID NO: 33320 - DNA, 20 bp, Artificial Sequence
  Description of Artificial Sequence: Synthetic oligonucleotide
  Target: ATXN1; (+) strand; PAM type: NNNNGHTT; PAM sequence: GCCTGCTT
gaacaagtcagctgatatga

SEQ ID NO: 33321 - DNA, 20 bp, Artificial Sequence
  Description of Artificial Sequence: Synthetic oligonucleotide
  Target: ATXN1; (+) strand; PAM type: NNNNGHTT; PAM sequence: CAGAGTTT
ttttctgtgtgaagaatgta

SEQ ID NO: 33322 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
caagaaaccatcacagctca

SEQ ID NO: 33323 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
gcatttgcataaacgctgaa

SEQ ID NO: 33324 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
cggcatagcataagcacacg

SEQ ID NO: 33325 - DNA, 20 bp, Artificial Sequence
  Description of Artificial Sequence: Synthetic oligonucleotide
  Target: ATXN1; (+) strand; PAM type: NNNNGHTT; PAM sequence: CAGTGATT
gcagtgtttgggagaatggc

SEQ ID NO: 33326 - DNA, 20 bp, Artificial Sequence
  Description of Artificial Sequence: Synthetic oligonucleotide
  Target: ATXN1; (+) strand; PAM type: NNNNGHTT; PAM sequence: CACTGCTT
gtgtgcaggtactcaggcca

SEQ ID NO: 33327 - DNA, 20 bp, Artificial Sequence
  Description of Artificial Sequence: Synthetic oligonucleotide
  Target: ATXN1; (+) strand; PAM type: NNNNGHTT; PAM sequence: AACTGATT
acccagcaactcagaacatt

SEQ ID NO: 33328 - DNA, 20 bp, Artificial Sequence
  Description of Artificial Sequence: Synthetic oligonucleotide
  Target: ATXN1; (+) strand; PAM type: NNNNGHTT; PAM sequence: CTTAGATT
gtgtcataaaagcaacatac

SEQ ID NO: 33329 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
ccaggactagaaaacaaatc

SEQ ID NO: 33330 - DNA, 20 bp, Artificial Sequence
  Description of Artificial Sequence: Synthetic oligonucleotide
  Target: ATXN1; (+) strand; PAM type: NNNNGHTT; PAM sequence: CTCAGCTT
ggttcaagcagtcctcccac

SEQ ID NO: 33331 - DNA, 20 bp, Artificial Sequence
  Description of Artificial Sequence: Synthetic oligonucleotide
  Target: ATXN1; (+) strand; PAM type: NNNNGHTT; PAM sequence: TGCCGATT
gacttattaagttattatga

SEQ ID NO: 33332 - DNA, 20 bp, Artificial Sequence
  Description of Artificial Sequence: Synthetic oligonucleotide
  Target: ATXN1; (+) strand; PAM type: NNNNGHTT; PAM sequence: GCATGTTT
cgaaaaagatacttgcacac

SEQ ID NO: 33333 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
cagcatttgcagtgacctgg

SEQ ID NO: 33334 - DNA, 20 bp, Artificial Sequence
  Description of Artificial Sequence: Synthetic oligonucleotide
  Target: ATXN1; (+) strand; PAM type: NNNNGHTT; PAM sequence: ACACGTTT
gccacttattttgaataagt

SEQ ID NO: 33335 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
gtgctatgcaagcagaaagt

SEQ ID NO: 33336 - DNA, 20 bp, Artificial Sequence
  Description of Artificial Sequence: Synthetic oligonucleotide
  Target: ATXN1; (+) strand; PAM type: NNNNGHTT; PAM sequence: ATGAGTTT
tttttgaacatatcctcaag

SEQ ID NO: 33337 - DNA, 20 bp, Artificial Sequence
  Description of Artificial Sequence: Synthetic oligonucleotide
  Target: ATXN1; (+) strand; PAM type: NNNNGHTT; PAM sequence: AGTGGCTT
ttgaaaggataaactcaata

SEQ ID NO: 33338 - DNA, 20 bp, Artificial Sequence
  Description of Artificial Sequence: Synthetic oligonucleotide
  Target: ATXN1; (+) strand; PAM type: NNNNGHTT; PAM sequence: GAATGTTT
catccacccagcaggctata

SEQ ID NO: 33339 - DNA, 20 bp, Artificial Sequence
  Description of Artificial Sequence: Synthetic oligonucleotide
  Target: ATXN1; (+) strand; PAM type: NNNNGHTT; PAM sequence: ATTGGTTT
ttctctcccaagggcaatga

SEQ ID NO: 33340 - DNA, 20 bp, Artificial Sequence
  Description of Artificial Sequence: Synthetic oligonucleotide
  Target: ATXN1; (+) strand; PAM type: NNNNGHTT; PAM sequence: ACAGGATT
ggcaatgaattggtttagcc

SEQ ID NO: 33341 - DNA, 20 bp, Artificial Sequence
  Description of Artificial Sequence: Synthetic oligonucleotide
  Target: ATXN1; (+) strand; PAM type: NNNNGHTT; PAM sequence: CCCTGATT
caacatgccagcgggtactt

SEQ ID NO: 33342 - DNA, 20 bp, Artificial Sequence
  Description of Artificial Sequence: Synthetic oligonucleotide
  Target: ATXN1; (+) strand; PAM type: NNNNGHTT; PAM sequence: ACTGGCTT
atgcaatccaggtgtacatc

SEQ ID NO: 33343 - DNA, 20 bp, Artificial Sequence
  Description of Artificial Sequence: Synthetic oligonucleotide
  Target: ATXN1; (+) strand; PAM type: NNNNGHTT; PAM sequence: ATCAGATT
cagatgcgcagaaacaaggc

SEQ ID NO: 33344 - DNA, 20 bp, Artificial Sequence
  Description of Artificial Sequence: Synthetic oligonucleotide
  Target: ATXN1; (+) strand; PAM type: NNNNGHTT; PAM sequence: CTCTGCTT
gaaacaaggcatcagattcc

SEQ ID NO: 33345 - DNA, 20 bp, Artificial Sequence
  Description of Artificial Sequence: Synthetic oligonucleotide
  Target: ATXN1; (+) strand; PAM type: NNNNGHTT; PAM sequence: TTAAGATT
ggggctgaatacatgcatct

SEQ ID NO: 33346 - DNA, 20 bp, Artificial Sequence
  Description of Artificial Sequence: Synthetic oligonucleotide
  Target: ATXN1; (+) strand; PAM type: NNNNGHTT; PAM sequence: TTAAGCTT
gcagaccacagtgcaaaaaa

SEQ ID NO: 33347 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
ctctggttccaggcctcttc

SEQ ID NO: 33348 - DNA, 20 bp, Artificial Sequence
  Description of Artificial Sequence: Synthetic oligonucleotide
  Target: ATXN1; (+) strand; PAM type: NNNNGHTT; PAM sequence: TCTGGATT
tattcttgtgagttcctgtg

SEQ ID NO: 33349 - DNA, 20 bp, Artificial Sequence
  Description of Artificial Sequence: Synthetic oligonucleotide
  Target: ATXN1; (+) strand; PAM type: NNNNGHTT; PAM sequence: CTGTGTTT
gagttcctgtgtctggattt

SEQ ID NO: 33350 - DNA, 20 bp, Artificial Sequence
  Description of Artificial Sequence: Synthetic oligonucleotide
  Target: ATXN1; (+) strand; PAM type: NNNNGHTT; PAM sequence: ACAGGCTT
acacgcgcattcaaatgtgc

SEQ ID NO: 33351 - DNA, 20 bp, Artificial Sequence
  Description of Artificial Sequence: Synthetic oligonucleotide
  Target: ATXN1; (+) strand; PAM type: NNNNGHTT; PAM sequence: GTGAGATT
taaatagctcttaggggagt

SEQ ID NO: 33352 - DNA, 20 bp, Artificial Sequence
  Description of Artificial Sequence: Synthetic oligonucleotide
  Target: ATXN1; (+) strand; PAM type: NNNNGHTT; PAM sequence: GAATGCTT
ccccgttacctcaaatcagt

SEQ ID NO: 33353 - DNA, 20 bp, Artificial Sequence
  Description of Artificial Sequence: Synthetic oligonucleotide
  Target: ATXN1; (+) strand; PAM type: NNNNGHTT; PAM sequence: CCCAGTTT
actcaatgtctgttaagtca

SEQ ID NO: 33354 - DNA, 20 bp, Artificial Sequence
  Description of Artificial Sequence: Synthetic oligonucleotide
  Target: ATXN1; (+) strand; PAM type: NNNNGHTT; PAM sequence: TGCCGTTT
aaaatattacaggcatataa

SEQ ID NO: 33355 - DNA, 20 bp, Artificial Sequence
  Description of Artificial Sequence: Synthetic oligonucleotide
  Target: ATXN1; (+) strand; PAM type: NNNNGHTT; PAM sequence: CTACGTTT
ctccactatttctcaggtat

SEQ ID NO: 33356 - DNA, 20 bp, Artificial Sequence
  Description of Artificial Sequence: Synthetic oligonucleotide
  Target: ATXN1; (+) strand; PAM type: NNNNGHTT; PAM sequence: TGACGTTT
gtacccaatctaagagccac

SEQ ID NO: 33357 - DNA, 20 bp, Artificial Sequence
  Description of Artificial Sequence: Synthetic oligonucleotide
  Target: ATXN1; (+) strand; PAM type: NNNNGHTT; PAM sequence: TATAGATT
tactgatgtatgtctacatt

SEQ ID NO: 33358 - DNA, 20 bp, Artificial Sequence
  Description of Artificial Sequence: Synthetic oligonucleotide
  Target: ATXN1; (+) strand; PAM type: NNNNGHTT; PAM sequence: GAAAGTTT
gacatggagttatacagaat

SEQ ID NO: 33359 - DNA, 20 bp, Artificial Sequence
  Description of Artificial Sequence: Synthetic oligonucleotide
  Target: ATXN1; (+) strand; PAM type: NNNNGHTT; PAM sequence: GGTGGCTT
aattcatttgggccaggcct

SEQ ID NO: 33360 - DNA, 20 bp, Artificial Sequence
  Description of Artificial Sequence: Synthetic oligonucleotide
  Target: ATXN1; (+) strand; PAM type: NNNNGHTT; PAM sequence: AGGAGTTT
caggaggatcccttgaggcc

SEQ ID NO: 33361 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
agcaagaccccatctataca

SEQ ID NO: 33362 - DNA, 20 bp, Artificial Sequence
  Description of Artificial Sequence: Synthetic oligonucleotide
  Target: ATXN1; (+) strand; PAM type: NNNNGHTT; PAM sequence: CGGAGCTT
aatggtgtgaacctgggagg

SEQ ID NO: 33363 - DNA, 20 bp, Artificial Sequence
  Description of Artificial Sequence: Synthetic oligonucleotide
  Target: ATXN1; (+) strand; PAM type: NNNNGHTT; PAM sequence: GCGAGATT
actccagcctgggcaacaga

SEQ ID NO: 33364 - DNA, 20 bp, Artificial Sequence
  Description of Artificial Sequence: Synthetic oligonucleotide
  Target: ATXN1; (+) strand; PAM type: NNNNGHTT; PAM sequence: AGAAGTTT
tggaagcatcacttgggccc

SEQ ID NO: 33365 - DNA, 20 bp, Artificial Sequence
  Description of Artificial Sequence: Synthetic oligonucleotide
  Target: ATXN1; (+) strand; PAM type: NNNNGHTT; PAM sequence: GAAGGTTT
aaagaaaaagaattcccttg

SEQ ID NO: 33366 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
aaaagaattcccttggaagg

SEQ ID NO: 33367 - DNA, 20 bp, Artificial Sequence
  Description of Artificial Sequence: Synthetic oligonucleotide
  Target: ATXN1; (+) strand; PAM type: NNNNGHTT; PAM sequence: ATAAGATT
aaggttttgcttttttagaa

SEQ ID NO: 33368 - DNA, 20 bp, Artificial Sequence
  Description of Artificial Sequence: Synthetic oligonucleotide
  Target: ATXN1; (+) strand; PAM type: NNNNGHTT; PAM sequence: AATTGTTT
aactatttttttaaatccaa

SEQ ID NO: 33369 - DNA, 20 bp, Artificial Sequence
  Description of Artificial Sequence: Synthetic oligonucleotide
  Target: ATXN1; (+) strand; PAM type: NNNNGHTT; PAM sequence: AATAGTTT
taaatccaaaattgttttaa

SEQ ID NO: 33370 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
agagcaggggtgtccaatct

SEQ ID NO: 33371 - DNA, 20 bp, Artificial Sequence
  Description of Artificial Sequence: Synthetic oligonucleotide
  Target: ATXN1; (+) strand; PAM type: NNNNGHTT; PAM sequence: GGACGATT
tcccaagttcccttttccca

SEQ ID NO: 33372 - DNA, 20 bp, Artificial Sequence
  Description of Artificial Sequence: Synthetic oligonucleotide
  Target: ATXN1; (+) strand; PAM type: NNNNGHTT; PAM sequence: CTAAGTTT
aaggaggaatttggcctaat

SEQ ID NO: 33373 - DNA, 20 bp, Artificial Sequence
  Description of Artificial Sequence: Synthetic oligonucleotide
  Target: ATXN1; (+) strand; PAM type: NNNNGHTT; PAM sequence: AAATGTTT
tggtgaggaaagagaattgt

SEQ ID NO: 33374 - DNA, 20 bp, Artificial Sequence
  Description of Artificial Sequence: Synthetic oligonucleotide
  Target: ATXN1; (+) strand; PAM type: NNNNGHTT; PAM sequence: TGGTGCTT
atgggagaggcgatagaata

SEQ ID NO: 33375 - DNA, 20 bp, Artificial Sequence
  Description of Artificial Sequence: Synthetic oligonucleotide
  Target: ATXN1; (+) strand; PAM type: NNNNGHTT; PAM sequence: ACTGGATT
tatctattattaatgataat

SEQ ID NO: 33376 - DNA, 20 bp, Artificial Sequence
  Description of Artificial Sequence: Synthetic oligonucleotide
  Target: ATXN1; (+) strand; PAM type: NNNNGHTT; PAM sequence: TTCTGTTT
cttccccaccacacacactt

SEQ ID NO: 33377 - DNA, 20 bp, Artificial Sequence
  Description of Artificial Sequence: Synthetic oligonucleotide
  Target: ATXN1; (+) strand; PAM type: NNNNGHTT; PAM sequence: AACGGCTT
ggtcattagatcatgctact

SEQ ID NO: 33378 - DNA, 20 bp, Artificial Sequence
  Description of Artificial Sequence: Synthetic oligonucleotide
  Target: ATXN1; (+) strand; PAM type: NNNNGHTT; PAM sequence: AAATGATT
cagtgagtgaacacacaaag

SEQ ID NO: 33379 - DNA, 20 bp, Artificial Sequence
  Description of Artificial Sequence: Synthetic oligonucleotide
  Target: ATXN1; (+) strand; PAM type: NNNNGHTT; PAM sequence: ATGAGATT
ggatacttcactttgctctc

SEQ ID NO: 33380 - DNA, 20 bp, Artificial Sequence
  Description of Artificial Sequence: Synthetic oligonucleotide
  Target: ATXN1; (+) strand; PAM type: NNNNGHTT; PAM sequence: ACCTGATT
gaaagccaagaaacgcatgc

SEQ ID NO: 33381 - DNA, 20 bp, Artificial Sequence
  Description of Artificial Sequence: Synthetic oligonucleotide
  Target: ATXN1; (+) strand; PAM type: NNNNGHTT; PAM sequence: CACAGTTT
atatagtcatattttgatac

SEQ ID NO: 33382 - DNA, 20 bp, Artificial Sequence
  Description of Artificial Sequence: Synthetic oligonucleotide
  Target: ATXN1; (+) strand; PAM type: NNNNGHTT; PAM sequence: GCAAGATT
ttgataccacagtttggatg

SEQ ID NO: 33383 - DNA, 20 bp, Artificial Sequence
  Description of Artificial Sequence: Synthetic oligonucleotide
  Target: ATXN1; (+) strand; PAM type: NNNNGHTT; PAM sequence: GAGAGCTT
ttcaatcctttttcctatca

SEQ ID NO: 33384 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
ttttcctatcagagagcttc

SEQ ID NO: 33385 - DNA, 20 bp, Artificial Sequence
  Description of Artificial Sequence: Synthetic oligonucleotide
  Target: ATXN1; (+) strand; PAM type: NNNNGHTT; PAM sequence: CAATGCTT
ctccatggatccacaacagt

SEQ ID NO: 33386 - DNA, 20 bp, Artificial Sequence
  Description of Artificial Sequence: Synthetic oligonucleotide
  Target: ATXN1; (+) strand; PAM type: NNNNGHTT; PAM sequence: TCGTGATT
caatacaaaaataaaggtaa

SEQ ID NO: 33387 - DNA, 20 bp, Artificial Sequence
  Description of Artificial Sequence: Synthetic oligonucleotide
  Target: ATXN1; (+) strand; PAM type: NNNNGHTT; PAM sequence: CAGTGTTT
tcatgtcaaattgtaatccc

SEQ ID NO: 33388 - DNA, 20 bp, Artificial Sequence
  Description of Artificial Sequence: Synthetic oligonucleotide
  Target: ATXN1; (+) strand; PAM type: NNNNGHTT; PAM sequence: ACGGGCTT
tggtgggagatgactggatc

SEQ ID NO: 33389 - DNA, 20 bp, Artificial Sequence
  Description of Artificial Sequence: Synthetic oligonucleotide
  Target: ATXN1; (+) strand; PAM type: NNNNGHTT; PAM sequence: CTTAGATT
ggagatgactggatcacggg

SEQ ID NO: 33390 - DNA, 20 bp, Artificial Sequence
  Description of Artificial Sequence: Synthetic oligonucleotide
  Target: ATXN1; (+) strand; PAM type: NNNNGHTT; PAM sequence: GGTTGTTT
agtgagttctcatgagatct

SEQ ID NO: 33391 - DNA, 20 bp, Artificial Sequence
  Description of Artificial Sequence: Synthetic oligonucleotide
  Target: ATXN1; (+) strand; PAM type: NNNNGHTT; PAM sequence: GCTGGCTT
gctccagccacgtaggacgt

SEQ ID NO: 33392 - DNA, 20 bp, Artificial Sequence
  Description of Artificial Sequence: Synthetic oligonucleotide
  Target: ATXN1; (+) strand; PAM type: NNNNGHTT; PAM sequence: CCATGATT
ggcttccccttctccttctg

SEQ ID NO: 33393 - DNA, 20 bp, Artificial Sequence
  Description of Artificial Sequence: Synthetic oligonucleotide
  Target: ATXN1; (+) strand; PAM type: NNNNGHTT; PAM sequence: GTAAGTTT
cttctccttctgccatgatt

SEQ ID NO: 33394 - DNA, 20 bp, Artificial Sequence
  Description of Artificial Sequence: Synthetic oligonucleotide
  Target: ATXN1; (+) strand; PAM type: NNNNGHTT; PAM sequence: CCATGTTT
gtttcctgaggcctccccag

SEQ ID NO: 33395 - DNA, 20 bp, Artificial Sequence
  Description of Artificial Sequence: Synthetic oligonucleotide
  Target: ATXN1; (+) strand; PAM type: NNNNGHTT; PAM sequence: ATGAGTTT
agacactaaaaatcttacat

SEQ ID NO: 33396 - DNA, 20 bp, Artificial Sequence
  Description of Artificial Sequence: Synthetic oligonucleotide
  Target: ATXN1; (+) strand; PAM type: NNNNGHTT; PAM sequence: TTGAGTTT
ccttggagctgatggcaggg

SEQ ID NO: 33397 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
aagggttaggcaggaacatt

SEQ ID NO: 33398 - DNA, 20 bp, Artificial Sequence
  Description of Artificial Sequence: Synthetic oligonucleotide
  Target: ATXN1; (+) strand; PAM type: NNNNGHTT; PAM sequence: TCAGGTTT
gcaatgccactgagctgtca

SEQ ID NO: 33399 - DNA, 20 bp, Artificial Sequence
  Description of Artificial Sequence: Synthetic oligonucleotide
  Target: ATXN1; (+) strand; PAM type: NNNNGHTT; PAM sequence: AGGGGCTT
ggcacatggaggaacagcat

SEQ ID NO: 33400 - DNA, 20 bp, Artificial Sequence
  Description of Artificial Sequence: Synthetic oligonucleotide
  Target: ATXN1; (+) strand; PAM type: NNNNGHTT; PAM sequence: TCTGGCTT
ggaggaacagcataggggct

SEQ ID NO: 33401 - DNA, 20 bp, Artificial Sequence
  Description of Artificial Sequence: Synthetic oligonucleotide
  Target: ATXN1; (+) strand; PAM type: NNNNGHTT; PAM sequence: TCTCGTTT
tctaactcagtgccttaatt

SEQ ID NO: 33402 - DNA, 20 bp, Artificial Sequence
  Description of Artificial Sequence: Synthetic oligonucleotide
  Target: ATXN1; (+) strand; PAM type: NNNNGHTT; PAM sequence: TAAAGTTT
ttctcgttttacttctagga

SEQ ID NO: 33403 - DNA, 20 bp, Artificial Sequence
  Description of Artificial Sequence: Synthetic oligonucleotide
  Target: ATXN1; (+) strand; PAM type: NNNNGHTT; PAM sequence: AGTTGATT
gtaggtactcgatacatacc

SEQ ID NO: 33404 - DNA, 20 bp, Artificial Sequence
  Description of Artificial Sequence: Synthetic oligonucleotide
  Target: ATXN1; (+) strand; PAM type: NNNNGHTT; PAM sequence: TTCTGATT
tatctaacatatcaatattt

SEQ ID NO: 33405 - DNA, 20 bp, Artificial Sequence
  Description of Artificial Sequence: Synthetic oligonucleotide
  Target: ATXN1; (+) strand; PAM type: NNNNGHTT; PAM sequence: ACAGGTTT
atatcaatatttttctgatt

SEQ ID NO: 33406 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
aatatttttctgattacagg

SEQ ID NO: 33407 - DNA, 20 bp, Artificial Sequence
  Description of Artificial Sequence: Synthetic oligonucleotide
  Target: ATXN1; (+) strand; PAM type: NNNNGHTT; PAM sequence: AATAGCTT
tgcctttgtgaaagaagaga

SEQ ID NO: 33408 - DNA, 20 bp, Artificial Sequence
  Description of Artificial Sequence: Synthetic oligonucleotide
  Target: ATXN1; (+) strand; PAM type: NNNNGHTT; PAM sequence: ATCTGATT
tacagggctacagtgtgttc

SEQ ID NO: 33409 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
aaaaatttctaggtagagat

SEQ ID NO: 33410 - DNA, 20 bp, Artificial Sequence
  Description of Artificial Sequence: Synthetic oligonucleotide
  Target: ATXN1; (+) strand; PAM type: NNNNGHTT; PAM sequence: TCAAGTTT
attaagtgaaggttgctcca

SEQ ID NO: 33411 - DNA, 20 bp, Artificial Sequence
  Description of Artificial Sequence: Synthetic oligonucleotide
  Target: ATXN1; (+) strand; PAM type: NNNNGHTT; PAM sequence: AGCTGCTT
tcctgagatgacaacatgtc

SEQ ID NO: 33412 - DNA, 20 bp, Artificial Sequence
  Description of Artificial Sequence: Synthetic oligonucleotide
  Target: ATXN1; (+) strand; PAM type: NNNNGHTT; PAM sequence: TGCTGCTT
gttctctgcattgcacttgc

SEQ ID NO: 33413 - DNA, 20 bp, Artificial Sequence
  Description of Artificial Sequence: Synthetic oligonucleotide
  Target: ATXN1; (+) strand; PAM type: NNNNGHTT; PAM sequence: ACAAGATT
tttaacatatttgcaaaggc

SEQ ID NO: 33414 - DNA, 20 bp, Artificial Sequence
  Description of Artificial Sequence: Synthetic oligonucleotide
  Target: ATXN1; (+) strand; PAM type: NNNNGHTT; PAM sequence: TTTTGCTT
gttatgctgagaacttaaac

SEQ ID NO: 33415 - DNA, 20 bp, Artificial Sequence
  Description of Artificial Sequence: Synthetic oligonucleotide
  Target: ATXN1; (+) strand; PAM type: NNNNGHTT; PAM sequence: TTTTGATT
caaatcactttttaaaaata

SEQ ID NO: 33416 - DNA, 20 bp, Artificial Sequence
  Description of Artificial Sequence: Synthetic oligonucleotide
  Target: ATXN1; (+) strand; PAM type: NNNNGHTT; PAM sequence: CGGGGTTT
ttgattatttttaaaggaga

SEQ ID NO: 33417 - DNA, 20 bp, Artificial Sequence
  Description of Artificial Sequence: Synthetic oligonucleotide
  Target: ATXN1; (+) strand; PAM type: NNNNGHTT; PAM sequence: CTAGGATT
tgcctcagcctcccaaagtg

SEQ ID NO: 33418 - DNA, 20 bp, Artificial Sequence
  Description of Artificial Sequence: Synthetic oligonucleotide
  Target: ATXN1; (+) strand; PAM type: NNNNGHTT; PAM sequence: AGATGCTT
aatagtacctgacacatagc

SEQ ID NO: 33419 - DNA, 20 bp, Artificial Sequence
  Description of Artificial Sequence: Synthetic oligonucleotide
  Target: ATXN1; (+) strand; PAM type: NNNNGHTT; PAM sequence: GTTAGCTT
atagcagatgcttagtgcat

SEQ ID NO: 33420 - DNA, 20 bp, Artificial Sequence
  Description of Artificial Sequence: Synthetic oligonucleotide
  Target: ATXN1; (+) strand; PAM type: NNNNGHTT; PAM sequence: GACAGATT
gatcaagcaaatctctgaat

SEQ ID NO: 33421 - DNA, 20 bp, Artificial Sequence
  Description of Artificial Sequence: Synthetic oligonucleotide
  Target: ATXN1; (+) strand; PAM type: NNNNGHTT; PAM sequence: CTATGCTT
gtacagaagtcaaactcaga

SEQ ID NO: 33422 - DNA, 20 bp, Artificial Sequence
  Description of Artificial Sequence: Synthetic oligonucleotide
  Target: ATXN1; (+) strand; PAM type: NNNNGHTT; PAM sequence: TCGTGATT
caaactcagactatgcttgc

SEQ ID NO: 33423 - DNA, 20 bp, Artificial Sequence
  Description of Artificial Sequence: Synthetic oligonucleotide
  Target: ATXN1; (+) strand; PAM type: NNNNGHTT; PAM sequence: GAGTGCTT
agtaggtagggatgaaccgg

SEQ ID NO: 33424 - DNA, 20 bp, Artificial Sequence
  Description of Artificial Sequence: Synthetic oligonucleotide
  Target: ATXN1; (+) strand; PAM type: NNNNGHTT; PAM sequence: GCCTGCTT
gcatagcagagggccgtcct

SEQ ID NO: 33425 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
tgtgatcattaaacgacaat

SEQ ID NO: 33426 - DNA, 20 bp, Artificial Sequence
  Description of Artificial Sequence: Synthetic oligonucleotide
  Target: ATXN1; (+) strand; PAM type: NNNNGHTT; PAM sequence: AACAGCTT
ttccatcagcagtaatgatg

SEQ ID NO: 33427 - DNA, 20 bp, Artificial Sequence
  Description of Artificial Sequence: Synthetic oligonucleotide
  Target: ATXN1; (+) strand; PAM type: NNNNGHTT; PAM sequence: GAGTGATT
aaaatacagaactttcctga

SEQ ID NO: 33428 - DNA, 20 bp, Artificial Sequence
  Description of Artificial Sequence: Synthetic oligonucleotide
  Target: ATXN1; (+) strand; PAM type: NNNNGHTT; PAM sequence: GGTGGTTT
aaaaaaactgaggatcaagt

SEQ ID NO: 33429 - DNA, 20 bp, Artificial Sequence
  Description of Artificial Sequence: Synthetic oligonucleotide
  Target: ATXN1; (+) strand; PAM type: NNNNGHTT; PAM sequence: ACTAGATT
tggtggtttctctgagtagc

SEQ ID NO: 33430 - DNA, 20 bp, Artificial Sequence
  Description of Artificial Sequence: Synthetic oligonucleotide
  Target: ATXN1; (+) strand; PAM type: NNNNGHTT; PAM sequence: GTCTGCTT
tctctgagtagcactagatt

SEQ ID NO: 33431 - DNA, 20 bp, Artificial Sequence
  Description of Artificial Sequence: Synthetic oligonucleotide
  Target: ATXN1; (+) strand; PAM type: NNNNGHTT; PAM sequence: GTATGCTT
cccgggaagaccacaggcag

SEQ ID NO: 33432 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
tgctacgtcaaataaagtgt

SEQ ID NO: 33433 - DNA, 20 bp, Artificial Sequence
  Description of Artificial Sequence: Synthetic oligonucleotide
  Target: ATXN1; (+) strand; PAM type: NNNNGHTT; PAM sequence: ATGTGATT
ctcacagttgggaacttcac

SEQ ID NO: 33434 - DNA, 20 bp, Artificial Sequence
  Description of Artificial Sequence: Synthetic oligonucleotide
  Target: ATXN1; (+) strand; PAM type: NNNNGHTT; PAM sequence: GCATGATT
tggaccatatcagaaagctg

SEQ ID NO: 33435 - DNA, 20 bp, Artificial Sequence
  Description of Artificial Sequence: Synthetic oligonucleotide
  Target: ATXN1; (+) strand; PAM type: NNNNGHTT; PAM sequence: ATAAGATT
cagaaagctggcatgattca

SEQ ID NO: 33436 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
atgctatgtgacctttagtg

SEQ ID NO: 33437 - DNA, 20 bp, Artificial Sequence
  Description of Artificial Sequence: Synthetic oligonucleotide
  Target: ATXN1; (+) strand; PAM type: NNNNGHTT; PAM sequence: ATAGGCTT
acagtctgtaaagctaattc

SEQ ID NO: 33438 - DNA, 20 bp, Artificial Sequence
  Description of Artificial Sequence: Synthetic oligonucleotide
  Target: ATXN1; (+) strand; PAM type: NNNNGHTT; PAM sequence: TACTGCTT
aggcttgctgcaaagataaa

SEQ ID NO: 33439 - DNA, 20 bp, Artificial Sequence
  Description of Artificial Sequence: Synthetic oligonucleotide
  Target: ATXN1; (+) strand; PAM type: NNNNGHTT; PAM sequence: TTTAGATT
gctgcaaagataaatactgc

SEQ ID NO: 33440 - DNA, 20 bp, Artificial Sequence
  Description of Artificial Sequence: Synthetic oligonucleotide
  Target: ATXN1; (+) strand; PAM type: NNNNGHTT; PAM sequence: CTTTGTTT
acaagagactttctatttta

SEQ ID NO: 33441 - DNA, 20 bp, Artificial Sequence
  Description of Artificial Sequence: Synthetic oligonucleotide
  Target: ATXN1; (+) strand; PAM type: NNNNGHTT; PAM sequence: AATCGCTT
tcgggaggctgaggcaggag

SEQ ID NO: 33442 - DNA, 20 bp, Artificial Sequence
  Description of Artificial Sequence: Synthetic oligonucleotide
  Target: ATXN1; (+) strand; PAM type: NNNNGHTT; PAM sequence: TGTGGTTT
atatacacggaaaatttcca

SEQ ID NO: 33443 - DNA, 20 bp, Artificial Sequence
  Description of Artificial Sequence: Synthetic oligonucleotide
  Target: ATXN1; (+) strand; PAM type: NNNNGHTT; PAM sequence: CTTGGTTT
gaaggggaggcagcagtagt

SEQ ID NO: 33444 - DNA, 20 bp, Artificial Sequence
  Description of Artificial Sequence: Synthetic oligonucleotide
  Target: ATXN1; (+) strand; PAM type: NNNNGHTT; PAM sequence: AAATGCTT
caggttcattgcacacaact

SEQ ID NO: 33445 - DNA, 20 bp, Artificial Sequence
  Description of Artificial Sequence: Synthetic oligonucleotide
  Target: ATXN1; (+) strand; PAM type: NNNNGHTT; PAM sequence: ATTAGATT
cttgctattcatttcccaaa

SEQ ID NO: 33446 - DNA, 20 bp, Artificial Sequence
  Description of Artificial Sequence: Synthetic oligonucleotide
  Target: ATXN1; (+) strand; PAM type: NNNNGHTT; PAM sequence: TACAGATT
tccttactgcaagaaataca

SEQ ID NO: 33447 - DNA, 20 bp, Artificial Sequence
  Description of Artificial Sequence: Synthetic oligonucleotide
  Target: ATXN1; (+) strand; PAM type: NNNNGHTT; PAM sequence: TGAAGCTT
tattttaaatataaggatag

SEQ ID NO: 33448 - DNA, 20 bp, Artificial Sequence
  Description of Artificial Sequence: Synthetic oligonucleotide
  Target: ATXN1; (+) strand; PAM type: NNNNGHTT; PAM sequence: ACGAGCTT
atctgtaatgtctggctaac

SEQ ID NO: 33449 - DNA, 20 bp, Artificial Sequence
  Description of Artificial Sequence: Synthetic oligonucleotide
  Target: ATXN1; (+) strand; PAM type: NNNNGHTT; PAM sequence: CCAGGCTT
gtctggctaacacgagcttc

SEQ ID NO: 33450 - DNA, 20 bp, Artificial Sequence
  Description of Artificial Sequence: Synthetic oligonucleotide
  Target: ATXN1; (+) strand; PAM type: NNNNGHTT; PAM sequence: ACTTGTTT
tccttgacccatagctctgt

SEQ ID NO: 33451 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
taattctcacctctgaatgc

SEQ ID NO: 33452 - DNA, 20 bp, Artificial Sequence
  Description of Artificial Sequence: Synthetic oligonucleotide
  Target: ATXN1; (+) strand; PAM type: NNNNGHTT; PAM sequence: CCATGTTT
atgctgatgttttttcattg

SEQ ID NO: 33453 - DNA, 20 bp, Artificial Sequence
  Description of Artificial Sequence: Synthetic oligonucleotide
  Target: ATXN1; (+) strand; PAM type: NNNNGHTT; PAM sequence: GAGAGCTT
cctgcatcttgggccccact

SEQ ID NO: 33454 - DNA, 20 bp, Artificial Sequence
  Description of Artificial Sequence: Synthetic oligonucleotide
  Target: ATXN1; (+) strand; PAM type: NNNNGHTT; PAM sequence: TCTAGTTT
agatgaacagtggccttctc

SEQ ID NO: 33455 - DNA, 20 bp, Artificial Sequence
  Description of Artificial Sequence: Synthetic oligonucleotide
  Target: ATXN1; (+) strand; PAM type: NNNNGHTT; PAM sequence: CTTAGCTT
gttagactccttgggtctat

SEQ ID NO: 33456 - DNA, 20 bp, Artificial Sequence
  Description of Artificial Sequence: Synthetic oligonucleotide
  Target: ATXN1; (+) strand; PAM type: NNNNGHTT; PAM sequence: CCCTGTTT
gggtctatcttagcttctct

SEQ ID NO: 33457 - DNA, 20 bp, Artificial Sequence
  Description of Artificial Sequence: Synthetic oligonucleotide
  Target: ATXN1; (+) strand; PAM type: NNNNGHTT; PAM sequence: TTCAGTTT
tcttagcttctctccctgtt

SEQ ID NO: 33458 - DNA, 20 bp, Artificial Sequence
  Description of Artificial Sequence: Synthetic oligonucleotide
  Target: ATXN1; (+) strand; PAM type: NNNNGHTT; PAM sequence: TTTGGATT
gcttctctccctgttttcag

SEQ ID NO: 33459 - DNA, 20 bp, Artificial Sequence
  Description of Artificial Sequence: Synthetic oligonucleotide
  Target: ATXN1; (+) strand; PAM type: NNNNGHTT; PAM sequence: TTTGGCTT
gtttggattttctacctcca

SEQ ID NO: 33460 - DNA, 20 bp, Artificial Sequence
  Description of Artificial Sequence: Synthetic oligonucleotide
  Target: ATXN1; (+) strand; PAM type: NNNNGHTT; PAM sequence: CATAGATT
atttacgaaaaacaagacaa

SEQ ID NO: 33461 - DNA, 20 bp, Artificial Sequence
  Description of Artificial Sequence: Synthetic oligonucleotide
  Target: ATXN1; (+) strand; PAM type: NNNNGHTT; PAM sequence: GGGAGTTT
caggtgaaccatctgaggtt

SEQ ID NO: 33462 - DNA, 20 bp, Artificial Sequence
  Description of Artificial Sequence: Synthetic oligonucleotide
  Target: ATXN1; (+) strand; PAM type: NNNNGHTT; PAM sequence: CCGAGATT
gaggcggaggttgcagtgag

SEQ ID NO: 33463 - DNA, 20 bp, Artificial Sequence
  Description of Artificial Sequence: Synthetic oligonucleotide
  Target: ATXN1; (+) strand; PAM type: NNNNGHTT; PAM sequence: TATAGATT
cagatgaaaactattatatt

SEQ ID NO: 33464 - DNA, 20 bp, Artificial Sequence
  Description of Artificial Sequence: Synthetic oligonucleotide
  Target: ATXN1; (+) strand; PAM type: NNNNGHTT; PAM sequence: CACAGATT
ccattgtgccttttaggaaa

SEQ ID NO: 33465 - DNA, 20 bp, Artificial Sequence
  Description of Artificial Sequence: Synthetic oligonucleotide
  Target: ATXN1; (+) strand; PAM type: NNNNGHTT; PAM sequence: CCTGGATT
catttgcagtctctaatggc

SEQ ID NO: 33466 - DNA, 20 bp, Artificial Sequence
  Description of Artificial Sequence: Synthetic oligonucleotide
  Target: ATXN1; (+) strand; PAM type: NNNNGHTT; PAM sequence: AAGGGATT
tttttaaaaacatttccccc

SEQ ID NO: 33467 - DNA, 20 bp, Artificial Sequence
  Description of Artificial Sequence: Synthetic oligonucleotide
  Target: ATXN1; (+) strand; PAM type: NNNNGHTT; PAM sequence: TTAGGTTT
ccccaagggattctgatcag

SEQ ID NO: 33468 - DNA, 20 bp, Artificial Sequence
  Description of Artificial Sequence: Synthetic oligonucleotide
  Target: ATXN1; (+) strand; PAM type: NNNNGHTT; PAM sequence: ACATGTTT
ggatccactttctaaaaata

SEQ ID NO: 33469 - DNA, 20 bp, Artificial Sequence
  Description of Artificial Sequence: Synthetic oligonucleotide
  Target: ATXN1; (+) strand; PAM type: NNNNGHTT; PAM sequence: CTATGATT
cggaggaaatttaagtataa

SEQ ID NO: 33470 - DNA, 20 bp, Artificial Sequence
  Description of Artificial Sequence: Synthetic oligonucleotide
  Target: ATXN1; (+) strand; PAM type: NNNNGHTT; PAM sequence: ATCTGTTT
ctatgattcatgaatttgtt

SEQ ID NO: 33471 - DNA, 20 bp, Artificial Sequence
  Description of Artificial Sequence: Synthetic oligonucleotide
  Target: ATXN1; (+) strand; PAM type: NNNNGHTT; PAM sequence: ATCAGTTT
tgtttttttcttcagaggat

SEQ ID NO: 33472 - DNA, 20 bp, Artificial Sequence
  Description of Artificial Sequence: Synthetic oligonucleotide
  Target: ATXN1; (+) strand; PAM type: NNNNGHTT; PAM sequence: GTTGGTTT
cagaggatatcagtttaagt

SEQ ID NO: 33473 - DNA, 20 bp, Artificial Sequence
  Description of Artificial Sequence: Synthetic oligonucleotide
  Target: ATXN1; (+) strand; PAM type: NNNNGHTT; PAM sequence: GAGAGTTT
aaggcaaacaactggcaaga

SEQ ID NO: 33474 - DNA, 20 bp, Artificial Sequence
  Description of Artificial Sequence: Synthetic oligonucleotide
  Target: ATXN1; (+) strand; PAM type: NNNNGHTT; PAM sequence: CAGGGCTT
tgcaaggtggtggatgacta

SEQ ID NO: 33475 - DNA, 20 bp, Artificial Sequence
  Description of Artificial Sequence: Synthetic oligonucleotide
  Target: ATXN1; (+) strand; PAM type: NNNNGHTT; PAM sequence: TGATGTTT
cagtgcccttgactgcagcc

SEQ ID NO: 33476 - DNA, 20 bp, Artificial Sequence
  Description of Artificial Sequence: Synthetic oligonucleotide
  Target: ATXN1; (+) strand; PAM type: NNNNGHTT; PAM sequence: CCTGGCTT
actgcagcctgatgtttcct

SEQ ID NO: 33477 - DNA, 20 bp, Artificial Sequence
  Description of Artificial Sequence: Synthetic oligonucleotide
  Target: ATXN1; (+) strand; PAM type: NNNNGHTT; PAM sequence: GTAGGTTT
ggcctacggtctcctttact

SEQ ID NO: 33478 - DNA, 20 bp, Artificial Sequence
  Description of Artificial Sequence: Synthetic oligonucleotide
  Target: ATXN1; (+) strand; PAM type: NNNNGHTT; PAM sequence: AGAAGCTT
gaggtggtcaagaacatgcc

SEQ ID NO: 33479 - DNA, 20 bp, Artificial Sequence
  Description of Artificial Sequence: Synthetic oligonucleotide
  Target: ATXN1; (+) strand; PAM type: NNNNGHTT; PAM sequence: GGCTGTTT
tttacagatggctgctgtca

SEQ ID NO: 33480 - DNA, 20 bp, Artificial Sequence
  Description of Artificial Sequence: Synthetic oligonucleotide
  Target: ATXN1; (+) strand; PAM type: NNNNGHTT; PAM sequence: CTTGGCTT
tgccaagcacaaagacagaa

SEQ ID NO: 33481 - DNA, 20 bp, Artificial Sequence
  Description of Artificial Sequence: Synthetic oligonucleotide
  Target: ATXN1; (+) strand; PAM type: NNNNGHTT; PAM sequence: AAGTGTTT
tggataactgccagtcataa

SEQ ID NO: 33482 - DNA, 20 bp, Artificial Sequence
  Description of Artificial Sequence: Synthetic oligonucleotide
  Target: ATXN1; (+) strand; PAM type: NNNNGHTT; PAM sequence: GCCTGATT
ataaaagtgtttctaaagtg

SEQ ID NO: 33483 - DNA, 20 bp, Artificial Sequence
  Description of Artificial Sequence: Synthetic oligonucleotide
  Target: ATXN1; (+) strand; PAM type: NNNNGHTT; PAM sequence: GGATGCTT
tcccctcctgttaggatcct

SEQ ID NO: 33484 - DNA, 20 bp, Artificial Sequence
  Description of Artificial Sequence: Synthetic oligonucleotide
  Target: ATXN1; (+) strand; PAM type: NNNNGHTT; PAM sequence: TTGTGCTT
gctatttatcaatggttatt

SEQ ID NO: 33485 - DNA, 20 bp, Artificial Sequence
  Description of Artificial Sequence: Synthetic oligonucleotide
  Target: ATXN1; (+) strand; PAM type: NNNNGHTT; PAM sequence: TGGAGTTT
attcttttttttttttgaga

SEQ ID NO: 33486 - DNA, 20 bp, Artificial Sequence
  Description of Artificial Sequence: Synthetic oligonucleotide
  Target: ATXN1; (+) strand; PAM type: NNNNGHTT; PAM sequence: AAGCGATT
aacctccgccttctaggttc

SEQ ID NO: 33487 - DNA, 20 bp, Artificial Sequence
  Description of Artificial Sequence: Synthetic oligonucleotide
  Target: ATXN1; (+) strand; PAM type: NNNNGHTT; PAM sequence: CTGGGATT
tgcctcagcctcctgagtag

SEQ ID NO: 33488 - DNA, 20 bp, Artificial Sequence
  Description of Artificial Sequence: Synthetic oligonucleotide
  Target: ATXN1; (+) strand; PAM type: NNNNGHTT; PAM sequence: CAGGGTTT
ttttgtatttttagtagaga
